United States Patent 12,553,037 (ENGINEERED CLASS 2, TYPE V REPRESSOR SYSTEMS) - sequence listing, part 4

SEQ ID NO: 38896 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgacgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38897 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattacgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38898 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaacgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38899 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcacgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38900 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtacgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38901 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccacgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38902 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcacggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38903 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacacgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38904 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacacgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38905 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcacgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38906 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccacggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38907 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattacgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38908 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcacgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38909 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacacggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38910 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctacgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38911 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccacgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38912 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcacgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38913 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagacgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38914 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaacgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38915 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttacggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38916 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatacgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38917 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagacgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38918 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38919 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactacgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38920 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcacgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38921 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcacgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38922 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcacgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38923 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcacggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38924 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttacgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38925 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagacgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38926 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcacgcgcctcctgcatgatgcgcggcccaaggagggagatgatcgccccttcttctggctctttgagaatgtggtggccatgggcgttagtgacaagagggacatcgagacgtcggaagagc

SEQ ID NO: 38927 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacacgctcctgcatgatgcgcggcccaaggagggagatgatcgccccttcttctggctctttgagaatgtggtggccatgggcgttagtgacaagagggacatcgagacgtcggaagagc

SEQ ID NO: 38928 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcacgctgcatgatgcgcggcccaaggagggagatgatcgccccttcttctggctctttgagaatgtggtggccatgggcgttagtgacaagagggacatcgagacgtcggaagagc

SEQ ID NO: 38929 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcacgcatgatgcgcggcccaaggagggagatgatcgccccttcttctggctctttgagaatgtggtggccatgggcgttagtgacaagagggacatcgagacgtcggaagagc

SEQ ID NO: 38930 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgacggatgcgcggcccaaggagggagatgatcgccccttcttctggctctttgagaatgtggtggccatgggcgttagtgacaagagggacatcgagacgtcggaagagc

SEQ ID NO: 38931 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatacggcgcggcccaaggagggagatgatcgccccttcttctggctctttgagaatgtggtggccatgggcgttagtgacaagagggacatcgagacgtcggaagagc

SEQ ID NO: 38932 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatacgcggcccaaggagggagatgatcgccccttcttctggctctttgagaatgtggtggccatgggcgttagtgacaagagggacatcgagacgtcggaagagc

SEQ ID NO: 38933 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgacgcccaaggagggagatgatcgccccttcttctggctctttgagaatgtggtggccatgggcgttagtgacaagagggacatcgagacgtcggaagagc

SEQ ID NO: 38934 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggacgaaggagggagatgatcgccccttcttctggctctttgagaatgtggtggccatgggcgttagtgacaagagggacatcgagacgtcggaagagc

SEQ ID NO: 38935 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccacggagggagatgatcgccccttcttctggctctttgagaatgtggtggccatgggcgttagtgacaagagggacatcgagacgtcggaagagc

SEQ ID NO: 38936 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagacgggagatgatcgccccttcttctggctctttgagaatgtggtggccatgggcgttagtgacaagagggacatcgagacgtcggaagagc

SEQ ID NO: 38937 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagacggatgatcgccccttcttctggctctttgagaatgtggtggccatgggcgttagtgacaagagggacatcgagacgtcggaagagc

SEQ ID NO: 38938 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaacggatcgccccttcttctggctctttgagaatgtggtggccatgggcgttagtgacaagagggacatcgagacgtcggaagagc

SEQ ID NO: 38939 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatacgcgccccttcttctggctctttgagaatgtggtggccatgggcgttagtgacaagagggacatcgagacgtcggaagagc

SEQ ID NO: 38940 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatacgcccttcttctggctctttgagaatgtggtggccatgggcgttagtgacaagagggacatcgagacgtcggaagagc

SEQ ID NO: 38941 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcacgttcttctggctctttgagaatgtggtggccatgggcgttagtgacaagagggacatcgagacgtcggaagagc

SEQ ID NO: 38942 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccacgttctggctctttgagaatgtggtggccatgggcgttagtgacaagagggacatcgagacgtcggaagagc

SEQ ID NO: 38943 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcacgtggctctttgagaatgtggtggccatgggcgttagtgacaagagggacatcgagacgtcggaagagc

SEQ ID NO: 38944 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcacgctctttgagaatgtggtggccatgggcgttagtgacaagagggacatcgagacgtcggaagagc

SEQ ID NO: 38945 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggacgtttgagaatgtggtggccatgggcgttagtgacaagagggacatcgagacgtcggaagagc

SEQ ID NO: 38946 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcacggagaatgtggtggccatgggcgttagtgacaagagggacatcgagacgtcggaagagc

SEQ ID NO: 38947 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttacgaatgtggtggccatgggcgttagtgacaagagggacatcgagacgtcggaagagc

SEQ ID NO: 38948 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagacggtggtggccatgggcgttagtgacaagagggacatcgagacgtcggaagagc

SEQ ID NO: 38949 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatacggtggccatgggcgttagtgacaagagggacatcgagacgtcggaagagc

SEQ ID NO: 38950 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgacggccatgggcgttagtgacaagagggacatcgagacgtcggaagagc

SEQ ID NO: 38951 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgacgatgggcgttagtgacaagagggacatcgagacgtcggaagagc

SEQ ID NO: 38952 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccacgggcgttagtgacaagagggacatcgagacgtcggaagagc

SEQ ID NO: 38953 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgacggttagtgacaagagggacatcgagacgtcggaagagc

SEQ ID NO: 38954 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcacgagtgacaagagggacatcgagacgtcggaagagc

SEQ ID NO: 38955 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttacggacaagagggacatcgagacgtcggaagagc

SEQ ID NO: 38956 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtacgaagagggacatcgagacgtcggaagagc

SEQ ID NO: 38957 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacacgagggacatcgagacgtcggaagagc

SEQ ID NO: 38958 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagacggacatcgagacgtcggaagagc

SEQ ID NO: 38959 - RNA, 296 nt, synthetic construct
  source 1..296: mol_type = other RNA
cgctcttccgcgtctcatgtacaccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38960 - RNA, 296 nt, synthetic construct
  source 1..296: mol_type = other RNA
cgctcttccgcgtctcatgtacgtcaccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38961 - RNA, 296 nt, synthetic construct
  source 1..296: mol_type = other RNA
cgctcttccgcgtctcatgtacgtcgggaccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38962 - RNA, 296 nt, synthetic construct
  source 1..296: mol_type = other RNA
cgctcttccgcgtctcatgtacgtcggggacacccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38963 - RNA, 296 nt, synthetic construct
  source 1..296: mol_type = other RNA
cgctcttccgcgtctcatgtacgtcggggacgtcaccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38964 - RNA, 296 nt, synthetic construct
  source 1..296: mol_type = other RNA
cgctcttccgcgtctcatgtacgtcggggacgtccgcaccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38965 - RNA, 296 nt, synthetic construct
  source 1..296: mol_type = other RNA
cgctcttccgcgtctcatgtacgtcggggacgtccgcagcaccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38966 - RNA, 296 nt, synthetic construct
  source 1..296: mol_type = other RNA
cgctcttccgcgtctcatgtacgtcggggacgtccgcagcgtcacccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38967 - RNA, 296 nt, synthetic construct
  source 1..296: mol_type = other RNA
cgctcttccgcgtctcatgtacgtcggggacgtccgcagcgtcacaaccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38968 - RNA, 296 nt, synthetic construct
  source 1..296: mol_type = other RNA
cgctcttccgcgtctcatgtacgtcggggacgtccgcagcgtcacacagacccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38969 - RNA, 296 nt, synthetic construct
  source 1..296: mol_type = other RNA
cgctcttccgcgtctcatgtacgtcggggacgtccgcagcgtcacacagaagaccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38970 - RNA, 296 nt, synthetic construct
  source 1..296: mol_type = other RNA
cgctcttccgcgtctcatgtacgtcggggacgtccgcagcgtcacacagaagcatacccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38971 - RNA, 296 nt, synthetic construct
  source 1..296: mol_type = other RNA
cgctcttccgcgtctcatgtacgtcggggacgtccgcagcgtcacacagaagcatatcaccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38972 - RNA, 296 nt, synthetic construct
  source 1..296: mol_type = other RNA
cgctcttccgcgtctcatgtacgtcggggacgtccgcagcgtcacacagaagcatatccagacctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38973 - RNA, 296 nt, synthetic construct
  source 1..296: mol_type = other RNA
cgctcttccgcgtctcatgtacgtcggggacgtccgcagcgtcacacagaagcatatccaggagaccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38974 - RNA, 296 nt, synthetic construct
  source 1..296: mol_type = other RNA
cgctcttccgcgtctcatgtacgtcggggacgtccgcagcgtcacacagaagcatatccaggagtggaccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38975 - RNA, 296 nt, synthetic construct
  source 1..296: mol_type = other RNA
cgctcttccgcgtctcatgtacgtcggggacgtccgcagcgtcacacagaagcatatccaggagtggggcaccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38976 - RNA, 296 nt, synthetic construct
  source 1..296: mol_type = other RNA
cgctcttccgcgtctcatgtacgtcggggacgtccgcagcgtcacacagaagcatatccaggagtggggcccaaccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38977 - RNA, 296 nt, synthetic construct
  source 1..296: mol_type = other RNA
cgctcttccgcgtctcatgtacgtcggggacgtccgcagcgtcacacagaagcatatccaggagtggggcccattcaccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38978 - RNA, 296 nt, synthetic construct
  source 1..296: mol_type = other RNA
cgctcttccgcgtctcatgtacgtcggggacgtccgcagcgtcacacagaagcatatccaggagtggggcccattcgacaccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38979 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgaccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38980 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgaccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38981 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattaccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38982 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaaccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38983 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcaccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38984 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtacctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38985 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccaccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38986 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38987 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacaccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38988 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacacctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38989 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcaccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38990 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccaccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38991 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattaccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38992 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcacccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38993 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacaccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38994 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctacccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38995 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38996 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38997 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38998 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaacctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 38999 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttaccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39000 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttataccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39001 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39002 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39003 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactacccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39004 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcaccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39005 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39006 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcacctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39007 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcaccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39008 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttaccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39009 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagacctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39010 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcacccgcctcctgcatgatgcgcggcccaaggagggagatgatcgccccttcttctggctctttgagaatgtggtggccatgggcgttagtgacaagagggacatcgagacgtcggaagagc

SEQ ID NO: 39011 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacaccctcctgcatgatgcgcggcccaaggagggagatgatcgccccttcttctggctctttgagaatgtggtggccatgggcgttagtgacaagagggacatcgagacgtcggaagagc

SEQ ID NO: 39012 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaccctgcatgatgcgcggcccaaggagggagatgatcgccccttcttctggctctttgagaatgtggtggccatgggcgttagtgacaagagggacatcgagacgtcggaagagc

SEQ ID NO: 39013 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcacccatgatgcgcggcccaaggagggagatgatcgccccttcttctggctctttgagaatgtggtggccatgggcgttagtgacaagagggacatcgagacgtcggaagagc

SEQ ID NO: 39014 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgaccgatgcgcggcccaaggagggagatgatcgccccttcttctggctctttgagaatgtggtggccatgggcgttagtgacaagagggacatcgagacgtcggaagagc

SEQ ID NO: 39015 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcataccgcgcggcccaaggagggagatgatcgccccttcttctggctctttgagaatgtggtggccatgggcgttagtgacaagagggacatcgagacgtcggaagagc

SEQ ID NO: 39016 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatacccggcccaaggagggagatgatcgccccttcttctggctctttgagaatgtggtggccatgggcgttagtgacaagagggacatcgagacgtcggaagagc

SEQ ID NO: 39017 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgacccccaaggagggagatgatcgccccttcttctggctctttgagaatgtggtggccatgggcgttagtgacaagagggacatcgagacgtcggaagagc

SEQ ID NO: 39018 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaccaaggagggagatgatcgccccttcttctggctctttgagaatgtggtggccatgggcgttagtgacaagagggacatcgagacgtcggaagagc

SEQ ID NO: 39019 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaccgagggagatgatcgccccttcttctggctctttgagaatgtggtggccatgggcgttagtgacaagagggacatcgagacgtcggaagagc

SEQ ID NO: 39020 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagaccggagatgatcgccccttcttctggctctttgagaatgtggtggccatgggcgttagtgacaagagggacatcgagacgtcggaagagc

SEQ ID NO: 39021 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagaccgatgatcgccccttcttctggctctttgagaatgtggtggccatgggcgttagtgacaagagggacatcgagacgtcggaagagc

SEQ ID NO: 39022 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaaccgatcgccccttcttctggctctttgagaatgtggtggccatgggcgttagtgacaagagggacatcgagacgtcggaagagc

SEQ ID NO: 39023 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatacccgccccttcttctggctctttgagaatgtggtggccatgggcgttagtgacaagagggacatcgagacgtcggaagagc

SEQ ID NO: 39024 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatacccccttcttctggctctttgagaatgtggtggccatgggcgttagtgacaagagggacatcgagacgtcggaagagc

SEQ ID NO: 39025 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcaccttcttctggctctttgagaatgtggtggccatgggcgttagtgacaagagggacatcgagacgtcggaagagc

SEQ ID NO: 39026 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaccttctggctctttgagaatgtggtggccatgggcgttagtgacaagagggacatcgagacgtcggaagagc

SEQ ID NO: 39027 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcacctggctctttgagaatgtggtggccatgggcgttagtgacaagagggacatcgagacgtcggaagagc

SEQ ID NO: 39028 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcaccctctttgagaatgtggtggccatgggcgttagtgacaagagggacatcgagacgtcggaagagc

SEQ ID NO: 39029 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggacctttgagaatgtggtggccatgggcgttagtgacaagagggacatcgagacgtcggaagagc

SEQ ID NO: 39030 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcaccgagaatgtggtggccatgggcgttagtgacaagagggacatcgagacgtcggaagagc

SEQ ID NO: 39031 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaccaatgtggtggccatgggcgttagtgacaagagggacatcgagacgtcggaagagc

SEQ ID NO: 39032 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaccgtggtggccatgggcgttagtgacaagagggacatcgagacgtcggaagagc

SEQ ID NO: 39033 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaataccgtggccatgggcgttagtgacaagagggacatcgagacgtcggaagagc

SEQ ID NO: 39034 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgaccgccatgggcgttagtgacaagagggacatcgagacgtcggaagagc

SEQ ID NO: 39035 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgaccatgggcgttagtgacaagagggacatcgagacgtcggaagagc

SEQ ID NO: 39036 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaccggcgttagtgacaagagggacatcgagacgtcggaagagc

SEQ ID NO: 39037 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgaccgttagtgacaagagggacatcgagacgtcggaagagc

SEQ ID NO: 39038 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcaccagtgacaagagggacatcgagacgtcggaagagc

SEQ ID NO: 39039 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttaccgacaagagggacatcgagacgtcggaagagc

SEQ ID NO: 39040 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaccaagagggacatcgagacgtcggaagagc

SEQ ID NO: 39041 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaccagggacatcgagacgtcggaagagc

SEQ ID NO: 39042 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaccgacatcgagacgtcggaagagc

SEQ ID NO: 39043 - RNA, 296 nt, synthetic construct
  source 1..296: mol_type = other RNA
cgctcttccgcgtctcatgtactagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39044 - RNA, 296 nt, synthetic construct
  source 1..296: mol_type = other RNA
cgctcttccgcgtctcatgtacgtctaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39045 - RNA, 296 nt, synthetic construct
  source 1..296: mol_type = other RNA
cgctcttccgcgtctcatgtacgtcgggtaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39046 - RNA, 296 nt, synthetic construct
  source 1..296: mol_type = other RNA
cgctcttccgcgtctcatgtacgtcggggactagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39047 - RNA, 296 nt, synthetic construct
  source 1..296: mol_type = other RNA
cgctcttccgcgtctcatgtacgtcggggacgtctagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39048 - RNA, 296 nt, synthetic construct
  source 1..296: mol_type = other RNA
cgctcttccgcgtctcatgtacgtcggggacgtccgctaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39049 - RNA, 296 nt, synthetic construct
  source 1..296: mol_type = other RNA
cgctcttccgcgtctcatgtacgtcggggacgtccgcagctagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39050 - RNA, 296 nt, synthetic construct
  source 1..296: mol_type = other RNA
cgctcttccgcgtctcatgtacgtcggggacgtccgcagcgtctagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39051 - RNA, 296 nt, synthetic construct
  source 1..296: mol_type = other RNA
cgctcttccgcgtctcatgtacgtcggggacgtccgcagcgtcacatagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39052 - RNA, 296 nt, synthetic construct
  source 1..296: mol_type = other RNA
cgctcttccgcgtctcatgtacgtcggggacgtccgcagcgtcacacagtagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39053 - RNA, 296 nt, synthetic construct
  source 1..296: mol_type = other RNA
cgctcttccgcgtctcatgtacgtcggggacgtccgcagcgtcacacagaagtagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39054 - RNA, 296 nt, synthetic construct
  source 1..296: mol_type = other RNA
cgctcttccgcgtctcatgtacgtcggggacgtccgcagcgtcacacagaagcattagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39055 - RNA, 296 nt, synthetic construct
  source 1..296: mol_type = other RNA
cgctcttccgcgtctcatgtacgtcggggacgtccgcagcgtcacacagaagcatatctaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39056 - RNA, 296 nt, synthetic construct
  source 1..296: mol_type = other RNA
cgctcttccgcgtctcatgtacgtcggggacgtccgcagcgtcacacagaagcatatccagtagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39057 - RNA, 296 nt, synthetic construct
  source 1..296: mol_type = other RNA
cgctcttccgcgtctcatgtacgtcggggacgtccgcagcgtcacacagaagcatatccaggagtagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39058 - RNA, 296 nt, synthetic construct
  source 1..296: mol_type = other RNA
cgctcttccgcgtctcatgtacgtcggggacgtccgcagcgtcacacagaagcatatccaggagtggtagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39059 - RNA, 296 nt, synthetic construct
  source 1..296: mol_type = other RNA
cgctcttccgcgtctcatgtacgtcggggacgtccgcagcgtcacacagaagcatatccaggagtggggctagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39060 - RNA, 296 nt, synthetic construct
  source 1..296: mol_type = other RNA
cgctcttccgcgtctcatgtacgtcggggacgtccgcagcgtcacacagaagcatatccaggagtggggcccataggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39061 - RNA, 296 nt, synthetic construct
  source 1..296: mol_type = other RNA
cgctcttccgcgtctcatgtacgtcggggacgtccgcagcgtcacacagaagcatatccaggagtggggcccattctagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39062 - RNA, 296 nt, synthetic construct
  source 1..296: mol_type = other RNA
cgctcttccgcgtctcatgtacgtcggggacgtccgcagcgtcacacagaagcatatccaggagtggggcccattcgactaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39063 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgtagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39064 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgtagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39065 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatttagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39066 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggatagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39067 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggctagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39068 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagttagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39069 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39070 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgctaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39071 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaactagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39072 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgactagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39073 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39074 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcctaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39075 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatttagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39076 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39077 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39078 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39079 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39080 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39081 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39082 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39083 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39084 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39085 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39086 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39087 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39088 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39089 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39090 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39091 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39092 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39093 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39094 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctagcgcctcctgcatgatgcgcggcccaaggagggagatgatcgccccttcttctggctctttgagaatgtggtggccatgggcgttagtgacaagagggacatcgagacgtcggaagagc

SEQ ID NO: 39095 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactagctcctgcatgatgcgcggcccaaggagggagatgatcgccccttcttctggctctttgagaatgtggtggccatgggcgttagtgacaagagggacatcgagacgtcggaagagc

SEQ ID NO: 39096 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctagctgcatgatgcgcggcccaaggagggagatgatcgccccttcttctggctctttgagaatgtggtggccatgggcgttagtgacaagagggacatcgagacgtcggaagagc

SEQ ID NO: 39097 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctagcatgatgcgcggcccaaggagggagatgatcgccccttcttctggctctttgagaatgtggtggccatgggcgttagtgacaagagggacatcgagacgtcggaagagc

SEQ ID NO: 39098 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtaggatgcgcggcccaaggagggagatgatcgccccttcttctggctctttgagaatgtggtggccatgggcgttagtgacaagagggacatcgagacgtcggaagagc

SEQ ID NO: 39099 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattaggcgcggcccaaggagggagatgatcgccccttcttctggctctttgagaatgtggtggccatgggcgttagtgacaagagggacatcgagacgtcggaagagc

SEQ ID NO: 39100 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattagcggcccaaggagggagatgatcgccccttcttctggctctttgagaatgtggtggccatgggcgttagtgacaagagggacatcgagacgtcggaagagc

SEQ ID NO: 39101 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtagcccaaggagggagatgatcgccccttcttctggctctttgagaatgtggtggccatgggcgttagtgacaagagggacatcgagacgtcggaagagc

SEQ ID NO: 39102 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtagaaggagggagatgatcgccccttcttctggctctttgagaatgtggtggccatgggcgttagtgacaagagggacatcgagacgtcggaagagc

SEQ ID NO: 39103 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctaggagggagatgatcgccccttcttctggctctttgagaatgtggtggccatgggcgttagtgacaagagggacatcgagacgtcggaagagc

SEQ ID NO: 39104 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtagggagatgatcgccccttcttctggctctttgagaatgtggtggccatgggcgttagtgacaagagggacatcgagacgtcggaagagc

SEQ ID NO: 39105 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtaggatgatcgccccttcttctggctctttgagaatgtggtggccatgggcgttagtgacaagagggacatcgagacgtcggaagagc

SEQ ID NO: 39106 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggataggatcgccccttcttctggctctttgagaatgtggtggccatgggcgttagtgacaagagggacatcgagacgtcggaagagc

SEQ ID NO: 39107 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattagcgccccttcttctggctctttgagaatgtggtggccatgggcgttagtgacaagagggacatcgagacgtcggaagagc

SEQ ID NO: 39108 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattagcccttcttctggctctttgagaatgtggtggccatgggcgttagtgacaagagggacatcgagacgtcggaagagc

SEQ ID NO: 39109 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctagttcttctggctctttgagaatgtggtggccatgggcgttagtgacaagagggacatcgagacgtcggaagagc

SEQ ID NO: 39110 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctagttctggctctttgagaatgtggtggccatgggcgttagtgacaagagggacatcgagacgtcggaagagc

SEQ ID NO: 39111 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctagtggctctttgagaatgtggtggccatgggcgttagtgacaagagggacatcgagacgtcggaagagc

SEQ ID NO: 39112 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctagctctttgagaatgtggtggccatgggcgttagtgacaagagggacatcgagacgtcggaagagc

SEQ ID NO: 39113 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtagtttgagaatgtggtggccatgggcgttagtgacaagagggacatcgagacgtcggaagagc

SEQ ID NO: 39114 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctaggagaatgtggtggccatgggcgttagtgacaagagggacatcgagacgtcggaagagc

SEQ ID NO: 39115 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttagaatgtggtggccatgggcgttagtgacaagagggacatcgagacgtcggaagagc

SEQ ID NO: 39116 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtaggtggtggccatgggcgttagtgacaagagggacatcgagacgtcggaagagc

SEQ ID NO: 39117 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattaggtggccatgggcgttagtgacaagagggacatcgagacgtcggaagagc

SEQ ID NO: 39118 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtaggccatgggcgttagtgacaagagggacatcgagacgtcggaagagc

SEQ ID NO: 39119 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtagatgggcgttagtgacaagagggacatcgagacgtcggaagagc

SEQ ID NO: 39120 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctagggcgttagtgacaagagggacatcgagacgtcggaagagc

SEQ ID NO: 39121 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtaggttagtgacaagagggacatcgagacgtcggaagagc

SEQ ID NO: 39122 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctagagtgacaagagggacatcgagacgtcggaagagc

SEQ ID NO: 39123 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttaggacaagagggacatcgagacgtcggaagagc

SEQ ID NO: 39124 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttagaagagggacatcgagacgtcggaagagc

SEQ ID NO: 39125 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactagagggacatcgagacgtcggaagagc

SEQ ID NO: 39126 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtaggacatcgagacgtcggaagagc

SEQ ID NO: 39127 - RNA, 296 nt, synthetic construct
  source 1..296: mol_type = other RNA
cgctcttccgcgtctcatgtactacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39128 - RNA, 296 nt, synthetic construct
  source 1..296: mol_type = other RNA
cgctcttccgcgtctcatgtacgtctacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39129 - RNA, 296 nt, synthetic construct
  source 1..296: mol_type = other RNA
cgctcttccgcgtctcatgtacgtcgggtacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39130 - RNA, 296 nt, synthetic construct
  source 1..296: mol_type = other RNA
cgctcttccgcgtctcatgtacgtcggggactaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39131 - RNA, 296 nt, synthetic construct
  source 1..296: mol_type = other RNA
cgctcttccgcgtctcatgtacgtcggggacgtctacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39132 - RNA, 296 nt, synthetic construct
  source 1..296: mol_type = other RNA
cgctcttccgcgtctcatgtacgtcggggacgtccgctacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39133 - RNA, 296 nt, synthetic construct
  source 1..296: mol_type = other RNA
cgctcttccgcgtctcatgtacgtcggggacgtccgcagctacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39134 - RNA, 296 nt, synthetic construct
  source 1..296: mol_type = other RNA
cgctcttccgcgtctcatgtacgtcggggacgtccgcagcgtctaccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39135 - RNA, 296 nt, synthetic construct
  source 1..296: mol_type = other RNA
cgctcttccgcgtctcatgtacgtcggggacgtccgcagcgtcacatacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39136 - RNA, 296 nt, synthetic construct
  source 1..296: mol_type = other RNA
cgctcttccgcgtctcatgtacgtcggggacgtccgcagcgtcacacagtaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39137 - RNA, 296 nt, synthetic construct
  source 1..296: mol_type = other RNA
cgctcttccgcgtctcatgtacgtcggggacgtccgcagcgtcacacagaagtacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39138 - RNA, 296 nt, synthetic construct
  source 1..296: mol_type = other RNA
cgctcttccgcgtctcatgtacgtcggggacgtccgcagcgtcacacagaagcattaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39139 - RNA, 296 nt, synthetic construct
  source 1..296: mol_type = other RNA
cgctcttccgcgtctcatgtacgtcggggacgtccgcagcgtcacacagaagcatatctacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39140 - RNA, 296 nt, synthetic construct
  source 1..296: mol_type = other RNA
cgctcttccgcgtctcatgtacgtcggggacgtccgcagcgtcacacagaagcatatccagtactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39141 - RNA, 296 nt, synthetic construct
  source 1..296: mol_type = other RNA
cgctcttccgcgtctcatgtacgtcggggacgtccgcagcgtcacacagaagcatatccaggagtacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39142 - RNA, 296 nt, synthetic construct
  source 1..296: mol_type = other RNA
cgctcttccgcgtctcatgtacgtcggggacgtccgcagcgtcacacagaagcatatccaggagtggtacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39143 - RNA, 296 nt, synthetic construct
  source 1..296: mol_type = other RNA
cgctcttccgcgtctcatgtacgtcggggacgtccgcagcgtcacacagaagcatatccaggagtggggctacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39144 - RNA, 296 nt, synthetic construct
  source 1..296: mol_type = other RNA
cgctcttccgcgtctcatgtacgtcggggacgtccgcagcgtcacacagaagcatatccaggagtggggcccatacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39145 - RNA, 296 nt, synthetic construct
  source 1..296: mol_type = other RNA
cgctcttccgcgtctcatgtacgtcggggacgtccgcagcgtcacacagaagcatatccaggagtggggcccattctacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39146 - RNA, 296 nt, synthetic construct
  source 1..296: mol_type = other RNA
cgctcttccgcgtctcatgtacgtcggggacgtccgcagcgtcacacagaagcatatccaggagtggggcccattcgactacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39147 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgtacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39148 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgtacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39149 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatttacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39150 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggatacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39151 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggctacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39152 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagttactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39153 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39154 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgctacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39155 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaactacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39156 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgactactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39157 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39158 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcctacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39159 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatttacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39160 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39161 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39162 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39163 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39164 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39165 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39166 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39167 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39168 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39169 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39170 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39171 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39172 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39173 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39174 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39175 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39176 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39177 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39178 - RNA, 296 nt, synthetic construct; identical to SEQ ID NO: 38380
  source 1..296: mol_type = other RNA

SEQ ID NO: 39179 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactacctcctgcatgatgcgcggcccaaggagggagatgatcgccccttcttctggctctttgagaatgtggtggccatgggcgttagtgacaagagggacatcgagacgtcggaagagc

SEQ ID NO: 39180 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctacctgcatgatgcgcggcccaaggagggagatgatcgccccttcttctggctctttgagaatgtggtggccatgggcgttagtgacaagagggacatcgagacgtcggaagagc

SEQ ID NO: 39181 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctaccatgatgcgcggcccaaggagggagatgatcgccccttcttctggctctttgagaatgtggtggccatgggcgttagtgacaagagggacatcgagacgtcggaagagc

SEQ ID NO: 39182 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtacgatgcgcggcccaaggagggagatgatcgccccttcttctggctctttgagaatgtggtggccatgggcgttagtgacaagagggacatcgagacgtcggaagagc

SEQ ID NO: 39183 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattacgcgcggcccaaggagggagatgatcgccccttcttctggctctttgagaatgtggtggccatgggcgttagtgacaagagggacatcgagacgtcggaagagc

SEQ ID NO: 39184 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattaccggcccaaggagggagatgatcgccccttcttctggctctttgagaatgtggtggccatgggcgttagtgacaagagggacatcgagacgtcggaagagc

SEQ ID NO: 39185 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtaccccaaggagggagatgatcgccccttcttctggctctttgagaatgtggtggccatgggcgttagtgacaagagggacatcgagacgtcggaagagc

SEQ ID NO: 39186 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtacaaggagggagatgatcgccccttcttctggctctttgagaatgtggtggccatgggcgttagtgacaagagggacatcgagacgtcggaagagc

SEQ ID NO: 39187 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctacgagggagatgatcgccccttcttctggctctttgagaatgtggtggccatgggcgttagtgacaagagggacatcgagacgtcggaagagc

SEQ ID NO: 39188 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtacggagatgatcgccccttcttctggctctttgagaatgtggtggccatgggcgttagtgacaagagggacatcgagacgtcggaagagc

SEQ ID NO: 39189 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtacgatgatcgccccttcttctggctctttgagaatgtggtggccatgggcgttagtgacaagagggacatcgagacgtcggaagagc

SEQ ID NO: 39190 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatacgatcgccccttcttctggctctttgagaatgtggtggccatgggcgttagtgacaagagggacatcgagacgtcggaagagc

SEQ ID NO: 39191 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattaccgccccttcttctggctctttgagaatgtggtggccatgggcgttagtgacaagagggacatcgagacgtcggaagagc

SEQ ID NO: 39192 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattaccccttcttctggctctttgagaatgtggtggccatgggcgttagtgacaagagggacatcgagacgtcggaagagc

SEQ ID NO: 39193 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctacttcttctggctctttgagaatgtggtggccatgggcgttagtgacaagagggacatcgagacgtcggaagagc

SEQ ID NO: 39194 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctacttctggctctttgagaatgtggtggccatgggcgttagtgacaagagggacatcgagacgtcggaagagc

SEQ ID NO: 39195 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctactggctctttgagaatgtggtggccatgggcgttagtgacaagagggacatcgagacgtcggaagagc

SEQ ID NO: 39196 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctacctctttgagaatgtggtggccatgggcgttagtgacaagagggacatcgagacgtcggaagagc

SEQ ID NO: 39197 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtactttgagaatgtggtggccatgggcgttagtgacaagagggacatcgagacgtcggaagagc

SEQ ID NO: 39198 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctacgagaatgtggtggccatgggcgttagtgacaagagggacatcgagacgtcggaagagc

SEQ ID NO: 39199 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttacaatgtggtggccatgggcgttagtgacaagagggacatcgagacgtcggaagagc

SEQ ID NO: 39200 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtacgtggtggccatgggcgttagtgacaagagggacatcgagacgtcggaagagc

SEQ ID NO: 39201 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattacgtggccatgggcgttagtgacaagagggacatcgagacgtcggaagagc

SEQ ID NO: 39202 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtacgccatgggcgttagtgacaagagggacatcgagacgtcggaagagc

SEQ ID NO: 39203 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtacatgggcgttagtgacaagagggacatcgagacgtcggaagagc

SEQ ID NO: 39204 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctacggcgttagtgacaagagggacatcgagacgtcggaagagc

SEQ ID NO: 39205 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtacgttagtgacaagagggacatcgagacgtcggaagagc

SEQ ID NO: 39206 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctacagtgacaagagggacatcgagacgtcggaagagc

SEQ ID NO: 39207 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttacgacaagagggacatcgagacgtcggaagagc

SEQ ID NO: 39208 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttacaagagggacatcgagacgtcggaagagc

SEQ ID NO: 39209 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactacagggacatcgagacgtcggaagagc

SEQ ID NO: 39210 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtacgacatcgagacgtcggaagagc

SEQ ID NO: 39211 - RNA, 296 nt, synthetic construct
  source 1..296: mol_type = other RNA
cgctcttccgcgtctcatgtacttgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39212 - RNA, 296 nt, synthetic construct
  source 1..296: mol_type = other RNA
cgctcttccgcgtctcatgtacgtcttggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39213 - RNA, 296 nt, synthetic construct
  source 1..296: mol_type = other RNA
cgctcttccgcgtctcatgtacgtcgggttggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39214 - RNA, 296 nt, synthetic construct
  source 1..296: mol_type = other RNA
cgctcttccgcgtctcatgtacgtcggggacttgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39215 - RNA, 296 nt, synthetic construct
  source 1..296: mol_type = other RNA
cgctcttccgcgtctcatgtacgtcggggacgtcttgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39216 - RNA, 296 nt, synthetic construct
  source 1..296: mol_type = other RNA
cgctcttccgcgtctcatgtacgtcggggacgtccgcttggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39217 - RNA, 296 nt, synthetic construct
  source 1..296: mol_type = other RNA
cgctcttccgcgtctcatgtacgtcggggacgtccgcagcttgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39218 - RNA, 296 nt, synthetic construct
  source 1..296: mol_type = other RNA
cgctcttccgcgtctcatgtacgtcggggacgtccgcagcgtcttgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39219 - RNA, 296 nt, synthetic construct
  source 1..296: mol_type = other RNA
cgctcttccgcgtctcatgtacgtcggggacgtccgcagcgtcacattgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39220 - RNA, 296 nt, synthetic construct
  source 1..296: mol_type = other RNA
cgctcttccgcgtctcatgtacgtcggggacgtccgcagcgtcacacagttgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39221 - RNA, 296 nt, synthetic construct
  source 1..296: mol_type = other RNA
cgctcttccgcgtctcatgtacgtcggggacgtccgcagcgtcacacagaagttgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39222 - RNA, 296 nt, synthetic construct
  source 1..296: mol_type = other RNA
cgctcttccgcgtctcatgtacgtcggggacgtccgcagcgtcacacagaagcatttgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39223 - RNA, 296 nt, synthetic construct
  source 1..296: mol_type = other RNA
cgctcttccgcgtctcatgtacgtcggggacgtccgcagcgtcacacagaagcatatcttggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39224 - RNA, 296 nt, synthetic construct
  source 1..296: mol_type = other RNA
cgctcttccgcgtctcatgtacgtcggggacgtccgcagcgtcacacagaagcatatccagttgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39225 - RNA, 296 nt, synthetic construct
  source 1..296: mol_type = other RNA
cgctcttccgcgtctcatgtacgtcggggacgtccgcagcgtcacacagaagcatatccaggagttgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39226 - RNA, 296 nt, synthetic construct
  source 1..296: mol_type = other RNA
cgctcttccgcgtctcatgtacgtcggggacgtccgcagcgtcacacagaagcatatccaggagtggttgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39227 - RNA, 296 nt, synthetic construct
  source 1..296: mol_type = other RNA
cgctcttccgcgtctcatgtacgtcggggacgtccgcagcgtcacacagaagcatatccaggagtggggcttgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39228 - RNA, 296 nt, synthetic construct
  source 1..296: mol_type = other RNA
cgctcttccgcgtctcatgtacgtcggggacgtccgcagcgtcacacagaagcatatccaggagtggggcccattggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39229 - RNA, 296 nt, synthetic construct
  source 1..296: mol_type = other RNA
cgctcttccgcgtctcatgtacgtcggggacgtccgcagcgtcacacagaagcatatccaggagtggggcccattcttgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39230 - RNA, 296 nt, synthetic construct
  source 1..296: mol_type = other RNA
cgctcttccgcgtctcatgtacgtcggggacgtccgcagcgtcacacagaagcatatccaggagtggggcccattcgacttggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39231 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgttgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39232 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgttgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39233 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattttgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39234 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggattgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39235 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcttgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39236 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtttgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39237 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccttgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39238 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcttggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39239 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacttgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39240 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacttgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39241 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcttgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39242 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccttggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39243 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattttgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39244 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcttgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39245 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacttggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39246 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctttgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39247 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccttgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39248 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcttgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39249 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagttgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39250 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggattgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39251 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttttggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39252 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatttgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39253 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagttgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39254 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtttgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39255 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactttgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39256 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcttgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39257 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcttgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39258 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39259 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39260 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttttgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39261 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39262 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcttgcgcctcctgcatgatgcgcggcccaaggagggagatgatcgccccttcttctggctctttgagaatgtggtggccatgggcgttagtgacaagagggacatcgagacgtcggaagagc

SEQ ID NO: 39263 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacttgctcctgcatgatgcgcggcccaaggagggagatgatcgccccttcttctggctctttgagaatgtggtggccatgggcgttagtgacaagagggacatcgagacgtcggaagagc

SEQ ID NO: 39264 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcttgctgcatgatgcgcggcccaaggagggagatgatcgccccttcttctggctctttgagaatgtggtggccatgggcgttagtgacaagagggacatcgagacgtcggaagagc

SEQ ID NO: 39265 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcttgcatgatgcgcggcccaaggagggagatgatcgccccttcttctggctctttgagaatgtggtggccatgggcgttagtgacaagagggacatcgagacgtcggaagagc

SEQ ID NO: 39266 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgttggatgcgcggcccaaggagggagatgatcgccccttcttctggctctttgagaatgtggtggccatgggcgttagtgacaagagggacatcgagacgtcggaagagc

SEQ ID NO: 39267 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatttggcgcggcccaaggagggagatgatcgccccttcttctggctctttgagaatgtggtggccatgggcgttagtgacaagagggacatcgagacgtcggaagagc

SEQ ID NO: 39268 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatttgcggcccaaggagggagatgatcgccccttcttctggctctttgagaatgtggtggccatgggcgttagtgacaagagggacatcgagacgtcggaagagc

SEQ ID NO: 39269 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgttgcccaaggagggagatgatcgccccttcttctggctctttgagaatgtggtggccatgggcgttagtgacaagagggacatcgagacgtcggaagagc

SEQ ID NO: 39270 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggttgaaggagggagatgatcgccccttcttctggctctttgagaatgtggtggccatgggcgttagtgacaagagggacatcgagacgtcggaagagc

SEQ ID NO: 39271 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccttggagggagatgatcgccccttcttctggctctttgagaatgtggtggccatgggcgttagtgacaagagggacatcgagacgtcggaagagc

SEQ ID NO: 39272 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagttgggagatgatcgccccttcttctggctctttgagaatgtggtggccatgggcgttagtgacaagagggacatcgagacgtcggaagagc

SEQ ID NO: 39273 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagttggatgatcgccccttcttctggctctttgagaatgtggtggccatgggcgttagtgacaagagggacatcgagacgtcggaagagc

SEQ ID NO: 39274 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggattggatcgccccttcttctggctctttgagaatgtggtggccatgggcgttagtgacaagagggacatcgagacgtcggaagagc

SEQ ID NO: 39275 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatttgcgccccttcttctggctctttgagaatgtggtggccatgggcgttagtgacaagagggacatcgagacgtcggaagagc

SEQ ID NO: 39276 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatttgcccttcttctggctctttgagaatgtggtggccatgggcgttagtgacaagagggacatcgagacgtcggaagagc

SEQ ID NO: 39277 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcttgttcttctggctctttgagaatgtggtggccatgggcgttagtgacaagagggacatcgagacgtcggaagagc

SEQ ID NO: 39278 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttgttctggctctttgagaatgtggtggccatgggcgttagtgacaagagggacatcgagacgtcggaagagc

SEQ ID NO: 39279 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttgtggctctttgagaatgtggtggccatgggcgttagtgacaagagggacatcgagacgtcggaagagc

SEQ ID NO: 39280 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcttgctctttgagaatgtggtggccatgggcgttagtgacaagagggacatcgagacgtcggaagagc

SEQ ID NO: 39281 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggttgtttgagaatgtggtggccatgggcgttagtgacaagagggacatcgagacgtcggaagagc

SEQ ID NO: 39282 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttggagaatgtggtggccatgggcgttagtgacaagagggacatcgagacgtcggaagagc

SEQ ID NO: 39283 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttttgaatgtggtggccatgggcgttagtgacaagagggacatcgagacgtcggaagagc

SEQ ID NO: 39284 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagttggtggtggccatgggcgttagtgacaagagggacatcgagacgtcggaagagc

SEQ ID NO: 39285 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatttggtggccatgggcgttagtgacaagagggacatcgagacgtcggaagagc

SEQ ID NO: 39286 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgttggccatgggcgttagtgacaagagggacatcgagacgtcggaagagc

SEQ ID NO: 39287 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgttgatgggcgttagtgacaagagggacatcgagacgtcggaagagc

SEQ ID NO: 39288 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccttgggcgttagtgacaagagggacatcgagacgtcggaagagc

SEQ ID NO: 39289 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgttggttagtgacaagagggacatcgagacgtcggaagagc

SEQ ID NO: 39290 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcttgagtgacaagagggacatcgagacgtcggaagagc

SEQ ID NO: 39291 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttttggacaagagggacatcgagacgtcggaagagc

SEQ ID NO: 39292 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtttgaagagggacatcgagacgtcggaagagc

SEQ ID NO: 39293 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacttgagggacatcgagacgtcggaagagc

SEQ ID NO: 39294 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagttggacatcgagacgtcggaagagc

SEQ ID NO: 39295 - RNA, 296 nt, synthetic construct
  source 1..296: mol_type = other RNA
cgctcttccgcgtctcatgtacttcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39296 - RNA, 296 nt, synthetic construct
  source 1..296: mol_type = other RNA
cgctcttccgcgtctcatgtacgtcttcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39297 - RNA, 296 nt, synthetic construct
  source 1..296: mol_type = other RNA
cgctcttccgcgtctcatgtacgtcgggttcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39298 - RNA, 296 nt, synthetic construct
  source 1..296: mol_type = other RNA
cgctcttccgcgtctcatgtacgtcggggacttccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39299 - RNA, 296 nt, synthetic construct
  source 1..296: mol_type = other RNA
cgctcttccgcgtctcatgtacgtcggggacgtcttcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39300 - RNA, 296 nt, synthetic construct
  source 1..296: mol_type = other RNA
cgctcttccgcgtctcatgtacgtcggggacgtccgcttcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39301 - RNA, 296 nt, synthetic construct
  source 1..296: mol_type = other RNA
cgctcttccgcgtctcatgtacgtcggggacgtccgcagcttcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39302 - RNA, 296 nt, synthetic construct
  source 1..296: mol_type = other RNA
cgctcttccgcgtctcatgtacgtcggggacgtccgcagcgtcttccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39303 - RNA, 296 nt, synthetic construct
  source 1..296: mol_type = other RNA
cgctcttccgcgtctcatgtacgtcggggacgtccgcagcgtcacattcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39304 - RNA, 296 nt, synthetic construct
  source 1..296: mol_type = other RNA
cgctcttccgcgtctcatgtacgtcggggacgtccgcagcgtcacacagttccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39305 - RNA, 296 nt, synthetic construct
  source 1..296: mol_type = other RNA
cgctcttccgcgtctcatgtacgtcggggacgtccgcagcgtcacacagaagttcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39306 - RNA, 296 nt, synthetic construct
  source 1..296: mol_type = other RNA
cgctcttccgcgtctcatgtacgtcggggacgtccgcagcgtcacacagaagcatttccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39307 - RNA, 296 nt, synthetic construct
  source 1..296: mol_type = other RNA
cgctcttccgcgtctcatgtacgtcggggacgtccgcagcgtcacacagaagcatatcttcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39308 - RNA, 296 nt, synthetic construct
  source 1..296: mol_type = other RNA
cgctcttccgcgtctcatgtacgtcggggacgtccgcagcgtcacacagaagcatatccagttctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39309 - RNA, 296 nt, synthetic construct
  source 1..296: mol_type = other RNA
cgctcttccgcgtctcatgtacgtcggggacgtccgcagcgtcacacagaagcatatccaggagttcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39310 - RNA, 296 nt, synthetic construct
  source 1..296: mol_type = other RNA
cgctcttccgcgtctcatgtacgtcggggacgtccgcagcgtcacacagaagcatatccaggagtggttcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39311 - RNA, 296 nt, synthetic construct
  source 1..296: mol_type = other RNA
cgctcttccgcgtctcatgtacgtcggggacgtccgcagcgtcacacagaagcatatccaggagtggggcttcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39312 - RNA, 296 nt, synthetic construct; identical to SEQ ID NO: 38380
  source 1..296: mol_type = other RNA

SEQ ID NO: 39313 - RNA, 296 nt, synthetic construct
  source 1..296: mol_type = other RNA
cgctcttccgcgtctcatgtacgtcggggacgtccgcagcgtcacacagaagcatatccaggagtggggcccattcttcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39314 - RNA, 296 nt, synthetic construct
  source 1..296: mol_type = other RNA
cgctcttccgcgtctcatgtacgtcggggacgtccgcagcgtcacacagaagcatatccaggagtggggcccattcgacttcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39315 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgttcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39316 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgttcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39317 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattttcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39318 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggattcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39319 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcttcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39320 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtttctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39321 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccttcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39322 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcttcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39323 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacttcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39324 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacttctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39325 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcttcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39326 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccttcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39327 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattttcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39328 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcttccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39329 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacttcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39330 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctttccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39331 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccttcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39332 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcttcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39333 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagttcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39334 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggattctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39335 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttttcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39336 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatttcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39337 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagttcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39338 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtttcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39339 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactttccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39340 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcttcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39341 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcttcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39342 - RNA, 296 nt, synthetic construct; identical to SEQ ID NO: 38380
  source 1..296: mol_type = other RNA

SEQ ID NO: 39343 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39344 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttttcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39345 - RNA, 296 nt, synthetic construct; identical to SEQ ID NO: 38380
  source 1..296: mol_type = other RNA

SEQ ID NO: 39346 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcttccgcctcctgcatgatgcgcggcccaaggagggagatgatcgccccttcttctggctctttgagaatgtggtggccatgggcgttagtgacaagagggacatcgagacgtcggaagagc

SEQ ID NO: 39347 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacttcctcctgcatgatgcgcggcccaaggagggagatgatcgccccttcttctggctctttgagaatgtggtggccatgggcgttagtgacaagagggacatcgagacgtcggaagagc

SEQ ID NO: 39348 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcttcctgcatgatgcgcggcccaaggagggagatgatcgccccttcttctggctctttgagaatgtggtggccatgggcgttagtgacaagagggacatcgagacgtcggaagagc

SEQ ID NO: 39349 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcttccatgatgcgcggcccaaggagggagatgatcgccccttcttctggctctttgagaatgtggtggccatgggcgttagtgacaagagggacatcgagacgtcggaagagc

SEQ ID NO: 39350 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgttcgatgcgcggcccaaggagggagatgatcgccccttcttctggctctttgagaatgtggtggccatgggcgttagtgacaagagggacatcgagacgtcggaagagc

SEQ ID NO: 39351 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatttcgcgcggcccaaggagggagatgatcgccccttcttctggctctttgagaatgtggtggccatgggcgttagtgacaagagggacatcgagacgtcggaagagc

SEQ ID NO: 39352 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatttccggcccaaggagggagatgatcgccccttcttctggctctttgagaatgtggtggccatgggcgttagtgacaagagggacatcgagacgtcggaagagc

SEQ ID NO: 39353 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgttccccaaggagggagatgatcgccccttcttctggctctttgagaatgtggtggccatgggcgttagtgacaagagggacatcgagacgtcggaagagc

SEQ ID NO: 39354 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggttcaaggagggagatgatcgccccttcttctggctctttgagaatgtggtggccatgggcgttagtgacaagagggacatcgagacgtcggaagagc

SEQ ID NO: 39355 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccttcgagggagatgatcgccccttcttctggctctttgagaatgtggtggccatgggcgttagtgacaagagggacatcgagacgtcggaagagc

SEQ ID NO: 39356 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagttcggagatgatcgccccttcttctggctctttgagaatgtggtggccatgggcgttagtgacaagagggacatcgagacgtcggaagagc

SEQ ID NO: 39357 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagttcgatgatcgccccttcttctggctctttgagaatgtggtggccatgggcgttagtgacaagagggacatcgagacgtcggaagagc

SEQ ID NO: 39358 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggattcgatcgccccttcttctggctctttgagaatgtggtggccatgggcgttagtgacaagagggacatcgagacgtcggaagagc

SEQ ID NO: 39359 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatttccgccccttcttctggctctttgagaatgtggtggccatgggcgttagtgacaagagggacatcgagacgtcggaagagc

SEQ ID NO: 39360 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatttccccttcttctggctctttgagaatgtggtggccatgggcgttagtgacaagagggacatcgagacgtcggaagagc

SEQ ID NO: 39361 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcttcttcttctggctctttgagaatgtggtggccatgggcgttagtgacaagagggacatcgagacgtcggaagagc

SEQ ID NO: 39362 - RNA, 296 nt, synthetic construct; identical to SEQ ID NO: 38380
  source 1..296: mol_type = other RNA

SEQ ID NO: 39363 - RNA, 296 nt, synthetic construct; identical to SEQ ID NO: 38380
  source 1..296: mol_type = other RNA

SEQ ID NO: 39364 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcttcctctttgagaatgtggtggccatgggcgttagtgacaagagggacatcgagacgtcggaagagc

SEQ ID NO: 39365 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggttctttgagaatgtggtggccatgggcgttagtgacaagagggacatcgagacgtcggaagagc

SEQ ID NO: 39366 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttcgagaatgtggtggccatgggcgttagtgacaagagggacatcgagacgtcggaagagc

SEQ ID NO: 39367 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttttcaatgtggtggccatgggcgttagtgacaagagggacatcgagacgtcggaagagc

SEQ ID NO: 39368 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagttcgtggtggccatgggcgttagtgacaagagggacatcgagacgtcggaagagc

SEQ ID NO: 39369 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatttcgtggccatgggcgttagtgacaagagggacatcgagacgtcggaagagc

SEQ ID NO: 39370 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgttcgccatgggcgttagtgacaagagggacatcgagacgtcggaagagc

SEQ ID NO: 39371 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgttcatgggcgttagtgacaagagggacatcgagacgtcggaagagc

SEQ ID NO: 39372 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccttcggcgttagtgacaagagggacatcgagacgtcggaagagc

SEQ ID NO: 39373 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgttcgttagtgacaagagggacatcgagacgtcggaagagc

SEQ ID NO: 39374 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcttcagtgacaagagggacatcgagacgtcggaagagc

SEQ ID NO: 39375 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttttcgacaagagggacatcgagacgtcggaagagc

SEQ ID NO: 39376 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtttcaagagggacatcgagacgtcggaagagc

SEQ ID NO: 39377 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacttcagggacatcgagacgtcggaagagc

SEQ ID NO: 39378 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagttcgacatcgagacgtcggaagagc

SEQ ID NO: 39379 - RNA, 296 nt, synthetic construct
  source 1..296: mol_type = other RNA
cgctcttccgcgtctcatgtactggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39380 - RNA, 296 nt, synthetic construct
  source 1..296: mol_type = other RNA
cgctcttccgcgtctcatgtacgtctgggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39381 - RNA, 296 nt, synthetic construct
  source 1..296: mol_type = other RNA
cgctcttccgcgtctcatgtacgtcgggtgggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39382 - RNA, 296 nt, synthetic construct
  source 1..296: mol_type = other RNA
cgctcttccgcgtctcatgtacgtcggggactggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39383 - RNA, 296 nt, synthetic construct
  source 1..296: mol_type = other RNA
cgctcttccgcgtctcatgtacgtcggggacgtctggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39384 - RNA, 296 nt, synthetic construct
  source 1..296: mol_type = other RNA
cgctcttccgcgtctcatgtacgtcggggacgtccgctgggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39385 - RNA, 296 nt, synthetic construct
  source 1..296: mol_type = other RNA
cgctcttccgcgtctcatgtacgtcggggacgtccgcagctggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39386 - RNA, 296 nt, synthetic construct
  source 1..296: mol_type = other RNA
cgctcttccgcgtctcatgtacgtcggggacgtccgcagcgtctggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39387 - RNA, 296 nt, synthetic construct
  source 1..296: mol_type = other RNA
cgctcttccgcgtctcatgtacgtcggggacgtccgcagcgtcacatggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39388 - RNA, 296 nt, synthetic construct
  source 1..296: mol_type = other RNA
cgctcttccgcgtctcatgtacgtcggggacgtccgcagcgtcacacagtggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39389 - RNA, 296 nt, synthetic construct
  source 1..296: mol_type = other RNA
cgctcttccgcgtctcatgtacgtcggggacgtccgcagcgtcacacagaagtggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39390 - RNA, 296 nt, synthetic construct
  source 1..296: mol_type = other RNA
cgctcttccgcgtctcatgtacgtcggggacgtccgcagcgtcacacagaagcattggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39391 - RNA, 296 nt, synthetic construct
  source 1..296: mol_type = other RNA
cgctcttccgcgtctcatgtacgtcggggacgtccgcagcgtcacacagaagcatatctgggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39392 - RNA, 296 nt, synthetic construct
  source 1..296: mol_type = other RNA
cgctcttccgcgtctcatgtacgtcggggacgtccgcagcgtcacacagaagcatatccagtggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39393 - RNA, 296 nt, synthetic construct; identical to SEQ ID NO: 38380
  source 1..296: mol_type = other RNA

SEQ ID NO: 39394 - RNA, 296 nt, synthetic construct
  source 1..296: mol_type = other RNA
cgctcttccgcgtctcatgtacgtcggggacgtccgcagcgtcacacagaagcatatccaggagtggtggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39395 - RNA, 296 nt, synthetic construct
  source 1..296: mol_type = other RNA
cgctcttccgcgtctcatgtacgtcggggacgtccgcagcgtcacacagaagcatatccaggagtggggctggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39396 - RNA, 296 nt, synthetic construct
  source 1..296: mol_type = other RNA
cgctcttccgcgtctcatgtacgtcggggacgtccgcagcgtcacacagaagcatatccaggagtggggcccatgggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39397 - RNA, 296 nt, synthetic construct
  source 1..296: mol_type = other RNA
cgctcttccgcgtctcatgtacgtcggggacgtccgcagcgtcacacagaagcatatccaggagtggggcccattctggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39398 - RNA, 296 nt, synthetic construct
  source 1..296: mol_type = other RNA
cgctcttccgcgtctcatgtacgtcggggacgtccgcagcgtcacacagaagcatatccaggagtggggcccattcgactgggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39399 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgtggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39400 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgtggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39401 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatttggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39402 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggatggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39403 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggctggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39404 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagttggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39405 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39406 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgctgggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39407 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaactggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39408 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgactggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39409 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39410 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcctgggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39411 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatttggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39412 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39413 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactgggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39414 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39415 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39416 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39417 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39418 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39419 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttgggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39420 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39421 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39422 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39423 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39424 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39425 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39426 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39427 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctgggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39428 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39429 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39430 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctggcgcctcctgcatgatgcgcggcccaaggagggagatgatcgccccttcttctggctctttgagaatgtggtggccatgggcgttagtgacaagagggacatcgagacgtcggaagagc

SEQ ID NO: 39431 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactggctcctgcatgatgcgcggcccaaggagggagatgatcgccccttcttctggctctttgagaatgtggtggccatgggcgttagtgacaagagggacatcgagacgtcggaagagc

SEQ ID NO: 39432 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctggctgcatgatgcgcggcccaaggagggagatgatcgccccttcttctggctctttgagaatgtggtggccatgggcgttagtgacaagagggacatcgagacgtcggaagagc

SEQ ID NO: 39433 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctggcatgatgcgcggcccaaggagggagatgatcgccccttcttctggctctttgagaatgtggtggccatgggcgttagtgacaagagggacatcgagacgtcggaagagc

SEQ ID NO: 39434 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtgggatgcgcggcccaaggagggagatgatcgccccttcttctggctctttgagaatgtggtggccatgggcgttagtgacaagagggacatcgagacgtcggaagagc

SEQ ID NO: 39435 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattgggcgcggcccaaggagggagatgatcgccccttcttctggctctttgagaatgtggtggccatgggcgttagtgacaagagggacatcgagacgtcggaagagc

SEQ ID NO: 39436 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattggcggcccaaggagggagatgatcgccccttcttctggctctttgagaatgtggtggccatgggcgttagtgacaagagggacatcgagacgtcggaagagc

SEQ ID NO: 39437 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtggcccaaggagggagatgatcgccccttcttctggctctttgagaatgtggtggccatgggcgttagtgacaagagggacatcgagacgtcggaagagc

SEQ ID NO: 39438 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtggaaggagggagatgatcgccccttcttctggctctttgagaatgtggtggccatgggcgttagtgacaagagggacatcgagacgtcggaagagc

SEQ ID NO: 39439 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctgggagggagatgatcgccccttcttctggctctttgagaatgtggtggccatgggcgttagtgacaagagggacatcgagacgtcggaagagc

SEQ ID NO: 39440 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtggggagatgatcgccccttcttctggctctttgagaatgtggtggccatgggcgttagtgacaagagggacatcgagacgtcggaagagc

SEQ ID NO: 39441 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtgggatgatcgccccttcttctggctctttgagaatgtggtggccatgggcgttagtgacaagagggacatcgagacgtcggaagagc

SEQ ID NO: 39442 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatgggatcgccccttcttctggctctttgagaatgtggtggccatgggcgttagtgacaagagggacatcgagacgtcggaagagc

SEQ ID NO: 39443 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattggcgccccttcttctggctctttgagaatgtggtggccatgggcgttagtgacaagagggacatcgagacgtcggaagagc

SEQ ID NO: 39444 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattggcccttcttctggctctttgagaatgtggtggccatgggcgttagtgacaagagggacatcgagacgtcggaagagc

SEQ ID NO: 39445 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctggttcttctggctctttgagaatgtggtggccatgggcgttagtgacaagagggacatcgagacgtcggaagagc

SEQ ID NO: 39446 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctggttctggctctttgagaatgtggtggccatgggcgttagtgacaagagggacatcgagacgtcggaagagc

SEQ ID NO: 39447 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctggtggctctttgagaatgtggtggccatgggcgttagtgacaagagggacatcgagacgtcggaagagc

SEQ ID NO: 39448 - RNA, 296 nt, synthetic construct; identical to SEQ ID NO: 38380
  source 1..296: mol_type = other RNA

SEQ ID NO: 39449 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtggtttgagaatgtggtggccatgggcgttagtgacaagagggacatcgagacgtcggaagagc

SEQ ID NO: 39450 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctgggagaatgtggtggccatgggcgttagtgacaagagggacatcgagacgtcggaagagc

SEQ ID NO: 39451 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttggaatgtggtggccatgggcgttagtgacaagagggacatcgagacgtcggaagagc

SEQ ID NO: 39452 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtgggtggtggccatgggcgttagtgacaagagggacatcgagacgtcggaagagc

SEQ ID NO: 39453 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattgggtggccatgggcgttagtgacaagagggacatcgagacgtcggaagagc

SEQ ID NO: 39454 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtgggccatgggcgttagtgacaagagggacatcgagacgtcggaagagc

SEQ ID NO: 39455 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtggatgggcgttagtgacaagagggacatcgagacgtcggaagagc

SEQ ID NO: 39456 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctggggcgttagtgacaagagggacatcgagacgtcggaagagc

SEQ ID NO: 39457 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtgggttagtgacaagagggacatcgagacgtcggaagagc

SEQ ID NO: 39458 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctggagtgacaagagggacatcgagacgtcggaagagc

SEQ ID NO: 39459 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttgggacaagagggacatcgagacgtcggaagagc

SEQ ID NO: 39460 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttggaagagggacatcgagacgtcggaagagc

SEQ ID NO: 39461 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactggagggacatcgagacgtcggaagagc

SEQ ID NO: 39462 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtgggacatcgagacgtcggaagagc

SEQ ID NO: 39463 - RNA, 296 nt, synthetic construct
  source 1..296: mol_type = other RNA
cgctcttccgcgtctcatgtactgcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39464 - RNA, 296 nt, synthetic construct
  source 1..296: mol_type = other RNA
cgctcttccgcgtctcatgtacgtctgcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39465 - RNA, 296 nt, synthetic construct
  source 1..296: mol_type = other RNA
cgctcttccgcgtctcatgtacgtcgggtgcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39466 - RNA, 296 nt, synthetic construct
  source 1..296: mol_type = other RNA
cgctcttccgcgtctcatgtacgtcggggactgccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39467 - RNA, 296 nt, synthetic construct
  source 1..296: mol_type = other RNA
cgctcttccgcgtctcatgtacgtcggggacgtctgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39468 - RNA, 296 nt, synthetic construct
  source 1..296: mol_type = other RNA
cgctcttccgcgtctcatgtacgtcggggacgtccgctgcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39469 - RNA, 296 nt, synthetic construct
  source 1..296: mol_type = other RNA
cgctcttccgcgtctcatgtacgtcggggacgtccgcagctgcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39470 - RNA, 296 nt, synthetic construct
  source 1..296: mol_type = other RNA
cgctcttccgcgtctcatgtacgtcggggacgtccgcagcgtctgccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39471 - RNA, 296 nt, synthetic construct
  source 1..296: mol_type = other RNA
cgctcttccgcgtctcatgtacgtcggggacgtccgcagcgtcacatgcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39472 - RNA, 296 nt, synthetic construct
  source 1..296: mol_type = other RNA
cgctcttccgcgtctcatgtacgtcggggacgtccgcagcgtcacacagtgccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39473 - RNA, 296 nt, synthetic construct
  source 1..296: mol_type = other RNA
cgctcttccgcgtctcatgtacgtcggggacgtccgcagcgtcacacagaagtgcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39474 - RNA, 296 nt, synthetic construct
  source 1..296: mol_type = other RNA
cgctcttccgcgtctcatgtacgtcggggacgtccgcagcgtcacacagaagcattgccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39475 - RNA, 296 nt, synthetic construct
  source 1..296: mol_type = other RNA
cgctcttccgcgtctcatgtacgtcggggacgtccgcagcgtcacacagaagcatatctgcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39476 - RNA, 296 nt, synthetic construct
  source 1..296: mol_type = other RNA
cgctcttccgcgtctcatgtacgtcggggacgtccgcagcgtcacacagaagcatatccagtgctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39477 - RNA, 296 nt, synthetic construct
  source 1..296: mol_type = other RNA
cgctcttccgcgtctcatgtacgtcggggacgtccgcagcgtcacacagaagcatatccaggagtgcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39478 - RNA, 296 nt, synthetic construct
  source 1..296: mol_type = other RNA
cgctcttccgcgtctcatgtacgtcggggacgtccgcagcgtcacacagaagcatatccaggagtggtgcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39479 - RNA, 296 nt, synthetic construct
  source 1..296: mol_type = other RNA
cgctcttccgcgtctcatgtacgtcggggacgtccgcagcgtcacacagaagcatatccaggagtggggctgcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39480 - RNA, 296 nt, synthetic construct
  source 1..296: mol_type = other RNA
cgctcttccgcgtctcatgtacgtcggggacgtccgcagcgtcacacagaagcatatccaggagtggggcccatgcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39481 - RNA, 296 nt, synthetic construct
  source 1..296: mol_type = other RNA
cgctcttccgcgtctcatgtacgtcggggacgtccgcagcgtcacacagaagcatatccaggagtggggcccattctgcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39482 - RNA, 296 nt, synthetic construct
  source 1..296: mol_type = other RNA
cgctcttccgcgtctcatgtacgtcggggacgtccgcagcgtcacacagaagcatatccaggagtggggcccattcgactgcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39483 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgtgcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39484 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgtgcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39485 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatttgcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39486 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggatgcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39487 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggctgcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39488 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagttgctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39489 - RNA, 296 nt, synthetic construct; identical to SEQ ID NO: 38380
  source 1..296: mol_type = other RNA

SEQ ID NO: 39490 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgctgcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39491 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaactgcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39492 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgactgctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39493 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctgcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39494 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcctgcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39495 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatttgcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39496 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctgccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39497 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactgcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39498 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttgccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39499 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39500 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctgcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39501 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtgcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39502 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatgctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39503 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttgcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39504 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattgcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39505 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtgcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39506 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttgcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39507 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttgccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39508 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39509 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctgcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39510 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctgctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39511 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctgcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39512 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttgcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39513 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtgctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39514 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctgccgcctcctgcatgatgcgcggcccaaggagggagatgatcgccccttcttctggctctttgagaatgtggtggccatgggcgttagtgacaagagggacatcgagacgtcggaagagc

SEQ ID NO: 39515 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactgcctcctgcatgatgcgcggcccaaggagggagatgatcgccccttcttctggctctttgagaatgtggtggccatgggcgttagtgacaagagggacatcgagacgtcggaagagc

SEQ ID NO: 39516 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctgcctgcatgatgcgcggcccaaggagggagatgatcgccccttcttctggctctttgagaatgtggtggccatgggcgttagtgacaagagggacatcgagacgtcggaagagc

SEQ ID NO: 39517 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctgccatgatgcgcggcccaaggagggagatgatcgccccttcttctggctctttgagaatgtggtggccatgggcgttagtgacaagagggacatcgagacgtcggaagagc

SEQ ID NO: 39518 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtgcgatgcgcggcccaaggagggagatgatcgccccttcttctggctctttgagaatgtggtggccatgggcgttagtgacaagagggacatcgagacgtcggaagagc

SEQ ID NO: 39519 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattgcgcgcggcccaaggagggagatgatcgccccttcttctggctctttgagaatgtggtggccatgggcgttagtgacaagagggacatcgagacgtcggaagagc

SEQ ID NO: 39520 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattgccggcccaaggagggagatgatcgccccttcttctggctctttgagaatgtggtggccatgggcgttagtgacaagagggacatcgagacgtcggaagagc

SEQ ID NO: 39521 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtgccccaaggagggagatgatcgccccttcttctggctctttgagaatgtggtggccatgggcgttagtgacaagagggacatcgagacgtcggaagagc

SEQ ID NO: 39522 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtgcaaggagggagatgatcgccccttcttctggctctttgagaatgtggtggccatgggcgttagtgacaagagggacatcgagacgtcggaagagc

SEQ ID NO: 39523 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctgcgagggagatgatcgccccttcttctggctctttgagaatgtggtggccatgggcgttagtgacaagagggacatcgagacgtcggaagagc

SEQ ID NO: 39524 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtgcggagatgatcgccccttcttctggctctttgagaatgtggtggccatgggcgttagtgacaagagggacatcgagacgtcggaagagc

SEQ ID NO: 39525 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtgcgatgatcgccccttcttctggctctttgagaatgtggtggccatgggcgttagtgacaagagggacatcgagacgtcggaagagc

SEQ ID NO: 39526 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatgcgatcgccccttcttctggctctttgagaatgtggtggccatgggcgttagtgacaagagggacatcgagacgtcggaagagc

SEQ ID NO: 39527 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattgccgccccttcttctggctctttgagaatgtggtggccatgggcgttagtgacaagagggacatcgagacgtcggaagagc

SEQ ID NO: 39528 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattgccccttcttctggctctttgagaatgtggtggccatgggcgttagtgacaagagggacatcgagacgtcggaagagc

SEQ ID NO: 39529 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctgcttcttctggctctttgagaatgtggtggccatgggcgttagtgacaagagggacatcgagacgtcggaagagc

SEQ ID NO: 39530 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctgcttctggctctttgagaatgtggtggccatgggcgttagtgacaagagggacatcgagacgtcggaagagc

SEQ ID NO: 39531 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctgctggctctttgagaatgtggtggccatgggcgttagtgacaagagggacatcgagacgtcggaagagc

SEQ ID NO: 39532 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgcctctttgagaatgtggtggccatgggcgttagtgacaagagggacatcgagacgtcggaagagc

SEQ ID NO: 39533 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtgctttgagaatgtggtggccatgggcgttagtgacaagagggacatcgagacgtcggaagagc

SEQ ID NO: 39534 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctgcgagaatgtggtggccatgggcgttagtgacaagagggacatcgagacgtcggaagagc

SEQ ID NO: 39535 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttgcaatgtggtggccatgggcgttagtgacaagagggacatcgagacgtcggaagagc

SEQ ID NO: 39536 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtgcgtggtggccatgggcgttagtgacaagagggacatcgagacgtcggaagagc

SEQ ID NO: 39537 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattgcgtggccatgggcgttagtgacaagagggacatcgagacgtcggaagagc

SEQ ID NO: 39538 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtgcgccatgggcgttagtgacaagagggacatcgagacgtcggaagagc

SEQ ID NO: 39539 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtgcatgggcgttagtgacaagagggacatcgagacgtcggaagagc

SEQ ID NO: 39540 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctgcggcgttagtgacaagagggacatcgagacgtcggaagagc

SEQ ID NO: 39541 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtgcgttagtgacaagagggacatcgagacgtcggaagagc

SEQ ID NO: 39542 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctgcagtgacaagagggacatcgagacgtcggaagagc

SEQ ID NO: 39543 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttgcgacaagagggacatcgagacgtcggaagagc

SEQ ID NO: 39544 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttgcaagagggacatcgagacgtcggaagagc

SEQ ID NO: 39545 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactgcagggacatcgagacgtcggaagagc

SEQ ID NO: 39546 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtgcgacatcgagacgtcggaagagc

SEQ ID NO: 39547 - RNA, 296 nt, synthetic construct
  source 1..296: mol_type = other RNA
cgctcttccgcgtctcatgtactcgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39548 - RNA, 296 nt, synthetic construct
  source 1..296: mol_type = other RNA
cgctcttccgcgtctcatgtacgtctcggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39549 - RNA, 296 nt, synthetic construct
  source 1..296: mol_type = other RNA
cgctcttccgcgtctcatgtacgtcgggtcggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39550 - RNA, 296 nt, synthetic construct
  source 1..296: mol_type = other RNA
cgctcttccgcgtctcatgtacgtcggggactcgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39551 - RNA, 296 nt, synthetic construct
  source 1..296: mol_type = other RNA
cgctcttccgcgtctcatgtacgtcggggacgtctcgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39552 - RNA, 296 nt, synthetic construct
  source 1..296: mol_type = other RNA
cgctcttccgcgtctcatgtacgtcggggacgtccgctcggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39553 - RNA, 296 nt, synthetic construct
  source 1..296: mol_type = other RNA
cgctcttccgcgtctcatgtacgtcggggacgtccgcagctcgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39554 - RNA, 296 nt, synthetic construct
  source 1..296: mol_type = other RNA
cgctcttccgcgtctcatgtacgtcggggacgtccgcagcgtctcgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39555 - RNA, 296 nt, synthetic construct
  source 1..296: mol_type = other RNA
cgctcttccgcgtctcatgtacgtcggggacgtccgcagcgtcacatcgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39556 - RNA, 296 nt, synthetic construct
  source 1..296: mol_type = other RNA
cgctcttccgcgtctcatgtacgtcggggacgtccgcagcgtcacacagtcgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39557 - RNA, 296 nt, synthetic construct
  source 1..296: mol_type = other RNA
cgctcttccgcgtctcatgtacgtcggggacgtccgcagcgtcacacagaagtcgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39558 - RNA, 296 nt, synthetic construct
  source 1..296: mol_type = other RNA
cgctcttccgcgtctcatgtacgtcggggacgtccgcagcgtcacacagaagcattcgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39559 - RNA, 296 nt, synthetic construct
  source 1..296: mol_type = other RNA
cgctcttccgcgtctcatgtacgtcggggacgtccgcagcgtcacacagaagcatatctcggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39560 - RNA, 296 nt, synthetic construct
  source 1..296: mol_type = other RNA
cgctcttccgcgtctcatgtacgtcggggacgtccgcagcgtcacacagaagcatatccagtcgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39561 - RNA, 296 nt, synthetic construct
  source 1..296: mol_type = other RNA
cgctcttccgcgtctcatgtacgtcggggacgtccgcagcgtcacacagaagcatatccaggagtcgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39562 - RNA, 296 nt, synthetic construct
  source 1..296: mol_type = other RNA
cgctcttccgcgtctcatgtacgtcggggacgtccgcagcgtcacacagaagcatatccaggagtggtcgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39563 - RNA, 296 nt, synthetic construct
  source 1..296: mol_type = other RNA
cgctcttccgcgtctcatgtacgtcggggacgtccgcagcgtcacacagaagcatatccaggagtggggctcgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39564 - RNA, 296 nt, synthetic construct
  source 1..296: mol_type = other RNA
cgctcttccgcgtctcatgtacgtcggggacgtccgcagcgtcacacagaagcatatccaggagtggggcccatcggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39565 - RNA, 296 nt, synthetic construct
  source 1..296: mol_type = other RNA
cgctcttccgcgtctcatgtacgtcggggacgtccgcagcgtcacacagaagcatatccaggagtggggcccattctcgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39566 - RNA, 296 nt, synthetic construct
  source 1..296: mol_type = other RNA
cgctcttccgcgtctcatgtacgtcggggacgtccgcagcgtcacacagaagcatatccaggagtggggcccattcgactcggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39567 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgtcgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39568 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgtcgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39569 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatttcgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39570 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggatcgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39571 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggctcgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39572 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagttcgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39573 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctcgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39574 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgctcggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39575 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaactcgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39576 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgactcgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39577 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39578 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcctcggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39579 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatttcgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39580 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctcgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39581 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactcggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39582 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttcgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39583 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctcgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39584 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctcgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39585 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtcgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39586 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatcgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39587 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttcggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39588 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattcgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39589 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtcgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39590 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttcgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39591 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttcgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39592 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctcgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39593 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctcgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39594 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctcgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39595 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctcggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39596 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttcgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39597 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtcgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39598 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctcgcgcctcctgcatgatgcgcggcccaaggagggagatgatcgccccttcttctggctctttgagaatgtggtggccatgggcgttagtgacaagagggacatcgagacgtcggaagagc

SEQ ID NO: 39599 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactcgctcctgcatgatgcgcggcccaaggagggagatgatcgccccttcttctggctctttgagaatgtggtggccatgggcgttagtgacaagagggacatcgagacgtcggaagagc

SEQ ID NO: 39600 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctcgctgcatgatgcgcggcccaaggagggagatgatcgccccttcttctggctctttgagaatgtggtggccatgggcgttagtgacaagagggacatcgagacgtcggaagagc

SEQ ID NO: 39601 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctcgcatgatgcgcggcccaaggagggagatgatcgccccttcttctggctctttgagaatgtggtggccatgggcgttagtgacaagagggacatcgagacgtcggaagagc

SEQ ID NO: 39602 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtcggatgcgcggcccaaggagggagatgatcgccccttcttctggctctttgagaatgtggtggccatgggcgttagtgacaagagggacatcgagacgtcggaagagc

SEQ ID NO: 39603 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattcggcgcggcccaaggagggagatgatcgccccttcttctggctctttgagaatgtggtggccatgggcgttagtgacaagagggacatcgagacgtcggaagagc

SEQ ID NO: 39604 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattcgcggcccaaggagggagatgatcgccccttcttctggctctttgagaatgtggtggccatgggcgttagtgacaagagggacatcgagacgtcggaagagc

SEQ ID NO: 39605 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtcgcccaaggagggagatgatcgccccttcttctggctctttgagaatgtggtggccatgggcgttagtgacaagagggacatcgagacgtcggaagagc

SEQ ID NO: 39606 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtcgaaggagggagatgatcgccccttcttctggctctttgagaatgtggtggccatgggcgttagtgacaagagggacatcgagacgtcggaagagc

SEQ ID NO: 39607 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctcggagggagatgatcgccccttcttctggctctttgagaatgtggtggccatgggcgttagtgacaagagggacatcgagacgtcggaagagc

SEQ ID NO: 39608 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtcgggagatgatcgccccttcttctggctctttgagaatgtggtggccatgggcgttagtgacaagagggacatcgagacgtcggaagagc

SEQ ID NO: 39609 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtcggatgatcgccccttcttctggctctttgagaatgtggtggccatgggcgttagtgacaagagggacatcgagacgtcggaagagc

SEQ ID NO: 39610 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatcggatcgccccttcttctggctctttgagaatgtggtggccatgggcgttagtgacaagagggacatcgagacgtcggaagagc

SEQ ID NO: 39611 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattcgcgccccttcttctggctctttgagaatgtggtggccatgggcgttagtgacaagagggacatcgagacgtcggaagagc

SEQ ID NO: 39612 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattcgcccttcttctggctctttgagaatgtggtggccatgggcgttagtgacaagagggacatcgagacgtcggaagagc

SEQ ID NO: 39613 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctcgttcttctggctctttgagaatgtggtggccatgggcgttagtgacaagagggacatcgagacgtcggaagagc

SEQ ID NO: 39614 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctcgttctggctctttgagaatgtggtggccatgggcgttagtgacaagagggacatcgagacgtcggaagagc

SEQ ID NO: 39615 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctcgtggctctttgagaatgtggtggccatgggcgttagtgacaagagggacatcgagacgtcggaagagc

SEQ ID NO: 39616 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctcgctctttgagaatgtggtggccatgggcgttagtgacaagagggacatcgagacgtcggaagagc

SEQ ID NO: 39617 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtcgtttgagaatgtggtggccatgggcgttagtgacaagagggacatcgagacgtcggaagagc

SEQ ID NO: 39618 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctcggagaatgtggtggccatgggcgttagtgacaagagggacatcgagacgtcggaagagc

SEQ ID NO: 39619 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttcgaatgtggtggccatgggcgttagtgacaagagggacatcgagacgtcggaagagc

SEQ ID NO: 39620 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtcggtggtggccatgggcgttagtgacaagagggacatcgagacgtcggaagagc

SEQ ID NO: 39621 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattcggtggccatgggcgttagtgacaagagggacatcgagacgtcggaagagc

SEQ ID NO: 39622 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtcggccatgggcgttagtgacaagagggacatcgagacgtcggaagagc

SEQ ID NO: 39623 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtcgatgggcgttagtgacaagagggacatcgagacgtcggaagagc

SEQ ID NO: 39624 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctcgggcgttagtgacaagagggacatcgagacgtcggaagagc

SEQ ID NO: 39625 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtcggttagtgacaagagggacatcgagacgtcggaagagc

SEQ ID NO: 39626 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctcgagtgacaagagggacatcgagacgtcggaagagc

SEQ ID NO: 39627 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttcggacaagagggacatcgagacgtcggaagagc

SEQ ID NO: 39628 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttcgaagagggacatcgagacgtcggaagagc

SEQ ID NO: 39629 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactcgagggacatcgagacgtcggaagagc

SEQ ID NO: 39630 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtcggacatcgagacgtcggaagagc

SEQ ID NO: 39631 - RNA, 296 nt, synthetic construct
  source 1..296: mol_type = other RNA
cgctcttccgcgtctcatgtactccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39632 - RNA, 296 nt, synthetic construct
  source 1..296: mol_type = other RNA
cgctcttccgcgtctcatgtacgtctccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39633 - RNA, 296 nt, synthetic construct
  source 1..296: mol_type = other RNA
cgctcttccgcgtctcatgtacgtcgggtccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39634 - RNA, 296 nt, synthetic construct
  source 1..296: mol_type = other RNA
cgctcttccgcgtctcatgtacgtcggggactcccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39635 - RNA, 296 nt, synthetic construct
  source 1..296: mol_type = other RNA
cgctcttccgcgtctcatgtacgtcggggacgtctccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39636 - RNA, 296 nt, synthetic construct
  source 1..296: mol_type = other RNA
cgctcttccgcgtctcatgtacgtcggggacgtccgctccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39637 - RNA, 296 nt, synthetic construct
  source 1..296: mol_type = other RNA
cgctcttccgcgtctcatgtacgtcggggacgtccgcagctccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39638 - RNA, 296 nt, synthetic construct
  source 1..296: mol_type = other RNA
cgctcttccgcgtctcatgtacgtcggggacgtccgcagcgtctcccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39639 - RNA, 296 nt, synthetic construct
  source 1..296: mol_type = other RNA
cgctcttccgcgtctcatgtacgtcggggacgtccgcagcgtcacatccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39640 - RNA, 296 nt, synthetic construct
  source 1..296: mol_type = other RNA
cgctcttccgcgtctcatgtacgtcggggacgtccgcagcgtcacacagtcccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39641 - RNA, 296 nt, synthetic construct
  source 1..296: mol_type = other RNA
cgctcttccgcgtctcatgtacgtcggggacgtccgcagcgtcacacagaagtccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39642 - RNA, 296 nt, synthetic construct
  source 1..296: mol_type = other RNA
cgctcttccgcgtctcatgtacgtcggggacgtccgcagcgtcacacagaagcattcccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39643 - RNA, 296 nt, synthetic construct
  source 1..296: mol_type = other RNA
cgctcttccgcgtctcatgtacgtcggggacgtccgcagcgtcacacagaagcatatctccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39644 - RNA, 296 nt, synthetic construct
  source 1..296: mol_type = other RNA
cgctcttccgcgtctcatgtacgtcggggacgtccgcagcgtcacacagaagcatatccagtcctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39645 - RNA, 296 nt, synthetic construct
  source 1..296: mol_type = other RNA
cgctcttccgcgtctcatgtacgtcggggacgtccgcagcgtcacacagaagcatatccaggagtccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39646 - RNA, 296 nt, synthetic construct
  source 1..296: mol_type = other RNA
cgctcttccgcgtctcatgtacgtcggggacgtccgcagcgtcacacagaagcatatccaggagtggtccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39647 - RNA, 296 nt, synthetic construct
  source 1..296: mol_type = other RNA
cgctcttccgcgtctcatgtacgtcggggacgtccgcagcgtcacacagaagcatatccaggagtggggctccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39648 - RNA, 296 nt, synthetic construct
  source 1..296: mol_type = other RNA
cgctcttccgcgtctcatgtacgtcggggacgtccgcagcgtcacacagaagcatatccaggagtggggcccatccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39649 - RNA, 296 nt, synthetic construct
  source 1..296: mol_type = other RNA
cgctcttccgcgtctcatgtacgtcggggacgtccgcagcgtcacacagaagcatatccaggagtggggcccattctccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39650 - RNA, 296 nt, synthetic construct
  source 1..296: mol_type = other RNA
cgctcttccgcgtctcatgtacgtcggggacgtccgcagcgtcacacagaagcatatccaggagtggggcccattcgactccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39651 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgtccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39652 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgtccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39653 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgatttccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39654 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggatccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39655 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggctccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39656 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagttcctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39657 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39658 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgctccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39659 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaactccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39660 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgactcctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39661 - RNA, 296 nt, synthetic construct; identical to SEQ ID NO: 38380
  source 1..296: mol_type = other RNA

SEQ ID NO: 39662 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcctccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39663 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccatttccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39664 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctcccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39665 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39666 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39667 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39668 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39669 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39670 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatcctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39671 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39672 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39673 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39674 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39675 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttcccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39676 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39677 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39678 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctcctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39679 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39680 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39681 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtcctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39682 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctcccgcctcctgcatgatgcgcggcccaaggagggagatgatcgccccttcttctggctctttgagaatgtggtggccatgggcgttagtgacaagagggacatcgagacgtcggaagagc

SEQ ID NO: 39683 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactccctcctgcatgatgcgcggcccaaggagggagatgatcgccccttcttctggctctttgagaatgtggtggccatgggcgttagtgacaagagggacatcgagacgtcggaagagc

SEQ ID NO: 39684 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctccctgcatgatgcgcggcccaaggagggagatgatcgccccttcttctggctctttgagaatgtggtggccatgggcgttagtgacaagagggacatcgagacgtcggaagagc

SEQ ID NO: 39685 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctcccatgatgcgcggcccaaggagggagatgatcgccccttcttctggctctttgagaatgtggtggccatgggcgttagtgacaagagggacatcgagacgtcggaagagc

SEQ ID NO: 39686 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtccgatgcgcggcccaaggagggagatgatcgccccttcttctggctctttgagaatgtggtggccatgggcgttagtgacaagagggacatcgagacgtcggaagagc

SEQ ID NO: 39687 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattccgcgcggcccaaggagggagatgatcgccccttcttctggctctttgagaatgtggtggccatgggcgttagtgacaagagggacatcgagacgtcggaagagc

SEQ ID NO: 39688 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattcccggcccaaggagggagatgatcgccccttcttctggctctttgagaatgtggtggccatgggcgttagtgacaagagggacatcgagacgtcggaagagc

SEQ ID NO: 39689 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtcccccaaggagggagatgatcgccccttcttctggctctttgagaatgtggtggccatgggcgttagtgacaagagggacatcgagacgtcggaagagc

SEQ ID NO: 39690 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtccaaggagggagatgatcgccccttcttctggctctttgagaatgtggtggccatgggcgttagtgacaagagggacatcgagacgtcggaagagc

SEQ ID NO: 39691 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctccgagggagatgatcgccccttcttctggctctttgagaatgtggtggccatgggcgttagtgacaagagggacatcgagacgtcggaagagc

SEQ ID NO: 39692 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtccggagatgatcgccccttcttctggctctttgagaatgtggtggccatgggcgttagtgacaagagggacatcgagacgtcggaagagc

SEQ ID NO: 39693 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtccgatgatcgccccttcttctggctctttgagaatgtggtggccatgggcgttagtgacaagagggacatcgagacgtcggaagagc

SEQ ID NO: 39694 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatccgatcgccccttcttctggctctttgagaatgtggtggccatgggcgttagtgacaagagggacatcgagacgtcggaagagc

SEQ ID NO: 39695 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattcccgccccttcttctggctctttgagaatgtggtggccatgggcgttagtgacaagagggacatcgagacgtcggaagagc

SEQ ID NO: 39696 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattcccccttcttctggctctttgagaatgtggtggccatgggcgttagtgacaagagggacatcgagacgtcggaagagc

SEQ ID NO: 39697 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctccttcttctggctctttgagaatgtggtggccatgggcgttagtgacaagagggacatcgagacgtcggaagagc

SEQ ID NO: 39698 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctccttctggctctttgagaatgtggtggccatgggcgttagtgacaagagggacatcgagacgtcggaagagc

SEQ ID NO: 39699 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctcctggctctttgagaatgtggtggccatgggcgttagtgacaagagggacatcgagacgtcggaagagc

SEQ ID NO: 39700 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctccctctttgagaatgtggtggccatgggcgttagtgacaagagggacatcgagacgtcggaagagc

SEQ ID NO: 39701 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtcctttgagaatgtggtggccatgggcgttagtgacaagagggacatcgagacgtcggaagagc

SEQ ID NO: 39702 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctccgagaatgtggtggccatgggcgttagtgacaagagggacatcgagacgtcggaagagc

SEQ ID NO: 39703 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttccaatgtggtggccatgggcgttagtgacaagagggacatcgagacgtcggaagagc

SEQ ID NO: 39704 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtccgtggtggccatgggcgttagtgacaagagggacatcgagacgtcggaagagc

SEQ ID NO: 39705 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattccgtggccatgggcgttagtgacaagagggacatcgagacgtcggaagagc

SEQ ID NO: 39706 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtccgccatgggcgttagtgacaagagggacatcgagacgtcggaagagc

SEQ ID NO: 39707 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtccatgggcgttagtgacaagagggacatcgagacgtcggaagagc

SEQ ID NO: 39708 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctccggcgttagtgacaagagggacatcgagacgtcggaagagc

SEQ ID NO: 39709 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtccgttagtgacaagagggacatcgagacgtcggaagagc

SEQ ID NO: 39710 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctccagtgacaagagggacatcgagacgtcggaagagc

SEQ ID NO: 39711 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttccgacaagagggacatcgagacgtcggaagagc

SEQ ID NO: 39712 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttccaagagggacatcgagacgtcggaagagc

SEQ ID NO: 39713 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactccagggacatcgagacgtcggaagagc

SEQ ID NO: 39714 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtccgacatcgagacgtcggaagagc

SEQ ID NO: 39715 - RNA, 296 nt, synthetic construct
  source 1..296: mol_type = other RNA
cgctcttccgcgtctcatgtacgagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39716 - RNA, 296 nt, synthetic construct
  source 1..296: mol_type = other RNA
cgctcttccgcgtctcatgtacgtcgaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39717 - RNA, 296 nt, synthetic construct
  source 1..296: mol_type = other RNA
cgctcttccgcgtctcatgtacgtcggggaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39718 - RNA, 296 nt, synthetic construct
  source 1..296: mol_type = other RNA
cgctcttccgcgtctcatgtacgtcggggacgagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39719 - RNA, 296 nt, synthetic construct
  source 1..296: mol_type = other RNA
cgctcttccgcgtctcatgtacgtcggggacgtcgagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39720 - RNA, 296 nt, synthetic construct
  source 1..296: mol_type = other RNA
cgctcttccgcgtctcatgtacgtcggggacgtccgcgaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39721 - RNA, 296 nt, synthetic construct
  source 1..296: mol_type = other RNA
cgctcttccgcgtctcatgtacgtcggggacgtccgcagcgagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39722 - RNA, 296 nt, synthetic construct
  source 1..296: mol_type = other RNA
cgctcttccgcgtctcatgtacgtcggggacgtccgcagcgtcgagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39723 - RNA, 296 nt, synthetic construct
  source 1..296: mol_type = other RNA
cgctcttccgcgtctcatgtacgtcggggacgtccgcagcgtcacagagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39724 - RNA, 296 nt, synthetic construct
  source 1..296: mol_type = other RNA
cgctcttccgcgtctcatgtacgtcggggacgtccgcagcgtcacacaggagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39725 - RNA, 296 nt, synthetic construct
  source 1..296: mol_type = other RNA
cgctcttccgcgtctcatgtacgtcggggacgtccgcagcgtcacacagaaggagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39726 - RNA, 296 nt, synthetic construct
  source 1..296: mol_type = other RNA
cgctcttccgcgtctcatgtacgtcggggacgtccgcagcgtcacacagaagcatgagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39727 - RNA, 296 nt, synthetic construct
  source 1..296: mol_type = other RNA
cgctcttccgcgtctcatgtacgtcggggacgtccgcagcgtcacacagaagcatatcgaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39728 - RNA, 296 nt, synthetic construct; identical to SEQ ID NO: 38380
  source 1..296: mol_type = other RNA

SEQ ID NO: 39729 - RNA, 296 nt, synthetic construct
  source 1..296: mol_type = other RNA
cgctcttccgcgtctcatgtacgtcggggacgtccgcagcgtcacacagaagcatatccaggaggagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39730 - RNA, 296 nt, synthetic construct
  source 1..296: mol_type = other RNA
cgctcttccgcgtctcatgtacgtcggggacgtccgcagcgtcacacagaagcatatccaggagtgggagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39731 - RNA, 296 nt, synthetic construct
  source 1..296: mol_type = other RNA
cgctcttccgcgtctcatgtacgtcggggacgtccgcagcgtcacacagaagcatatccaggagtggggcgagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39732 - RNA, 296 nt, synthetic construct
  source 1..296: mol_type = other RNA
cgctcttccgcgtctcatgtacgtcggggacgtccgcagcgtcacacagaagcatatccaggagtggggcccagaggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39733 - RNA, 296 nt, synthetic construct
  source 1..296: mol_type = other RNA
cgctcttccgcgtctcatgtacgtcggggacgtccgcagcgtcacacagaagcatatccaggagtggggcccattcgagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39734 - RNA, 296 nt, synthetic construct
  source 1..296: mol_type = other RNA
cgctcttccgcgtctcatgtacgtcggggacgtccgcagcgtcacacagaagcatatccaggagtggggcccattcgacgaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39735 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39736 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtggagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39737 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattgagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39738 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggagagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39739 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcgagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39740 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtgagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39741 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccgagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39742 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcgaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39743 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39744 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacgagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39745 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcgagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39746 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccgaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39747 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39748 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39749 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39750 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39751 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39752 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39753 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39754 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39755 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39756 - RNA, 296 nt, synthetic construct; identical to SEQ ID NO: 38380
  source 1..296: mol_type = other RNA

SEQ ID NO: 39757 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39758 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39759 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39760 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39761 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39762 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39763 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39764 - RNA, 296 nt, synthetic construct; identical to SEQ ID NO: 38380
  source 1..296: mol_type = other RNA

SEQ ID NO: 39765 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39766 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgagcgcctcctgcatgatgcgcggcccaaggagggagatgatcgccccttcttctggctctttgagaatgtggtggccatgggcgttagtgacaagagggacatcgagacgtcggaagagc

SEQ ID NO: 39767 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgagctcctgcatgatgcgcggcccaaggagggagatgatcgccccttcttctggctctttgagaatgtggtggccatgggcgttagtgacaagagggacatcgagacgtcggaagagc

SEQ ID NO: 39768 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgagctgcatgatgcgcggcccaaggagggagatgatcgccccttcttctggctctttgagaatgtggtggccatgggcgttagtgacaagagggacatcgagacgtcggaagagc

SEQ ID NO: 39769 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgagcatgatgcgcggcccaaggagggagatgatcgccccttcttctggctctttgagaatgtggtggccatgggcgttagtgacaagagggacatcgagacgtcggaagagc

SEQ ID NO: 39770 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggaggatgcgcggcccaaggagggagatgatcgccccttcttctggctctttgagaatgtggtggccatgggcgttagtgacaagagggacatcgagacgtcggaagagc

SEQ ID NO: 39771 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgaggcgcggcccaaggagggagatgatcgccccttcttctggctctttgagaatgtggtggccatgggcgttagtgacaagagggacatcgagacgtcggaagagc

SEQ ID NO: 39772 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgagcggcccaaggagggagatgatcgccccttcttctggctctttgagaatgtggtggccatgggcgttagtgacaagagggacatcgagacgtcggaagagc

SEQ ID NO: 39773 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggagcccaaggagggagatgatcgccccttcttctggctctttgagaatgtggtggccatgggcgttagtgacaagagggacatcgagacgtcggaagagc

SEQ ID NO: 39774 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggagaaggagggagatgatcgccccttcttctggctctttgagaatgtggtggccatgggcgttagtgacaagagggacatcgagacgtcggaagagc

SEQ ID NO: 39775 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgaggagggagatgatcgccccttcttctggctctttgagaatgtggtggccatgggcgttagtgacaagagggacatcgagacgtcggaagagc

SEQ ID NO: 39776 - RNA, 296 nt, synthetic construct; identical to SEQ ID NO: 38380
  source 1..296: mol_type = other RNA

SEQ ID NO: 39777 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggaggatgatcgccccttcttctggctctttgagaatgtggtggccatgggcgttagtgacaagagggacatcgagacgtcggaagagc

SEQ ID NO: 39778 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagaggatcgccccttcttctggctctttgagaatgtggtggccatgggcgttagtgacaagagggacatcgagacgtcggaagagc

SEQ ID NO: 39779 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgagcgccccttcttctggctctttgagaatgtggtggccatgggcgttagtgacaagagggacatcgagacgtcggaagagc

SEQ ID NO: 39780 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgagcccttcttctggctctttgagaatgtggtggccatgggcgttagtgacaagagggacatcgagacgtcggaagagc

SEQ ID NO: 39781 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgagttcttctggctctttgagaatgtggtggccatgggcgttagtgacaagagggacatcgagacgtcggaagagc

SEQ ID NO: 39782 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgagttctggctctttgagaatgtggtggccatgggcgttagtgacaagagggacatcgagacgtcggaagagc

SEQ ID NO: 39783 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgagtggctctttgagaatgtggtggccatgggcgttagtgacaagagggacatcgagacgtcggaagagc

SEQ ID NO: 39784 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgagctctttgagaatgtggtggccatgggcgttagtgacaagagggacatcgagacgtcggaagagc

SEQ ID NO: 39785 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggagtttgagaatgtggtggccatgggcgttagtgacaagagggacatcgagacgtcggaagagc

SEQ ID NO: 39786 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgaggagaatgtggtggccatgggcgttagtgacaagagggacatcgagacgtcggaagagc

SEQ ID NO: 39787 - RNA, 296 nt, synthetic construct; identical to SEQ ID NO: 38380
  source 1..296: mol_type = other RNA

SEQ ID NO: 39788 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggaggtggtggccatgggcgttagtgacaagagggacatcgagacgtcggaagagc

SEQ ID NO: 39789 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgaggtggccatgggcgttagtgacaagagggacatcgagacgtcggaagagc

SEQ ID NO: 39790 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggaggccatgggcgttagtgacaagagggacatcgagacgtcggaagagc

SEQ ID NO: 39791 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggagatgggcgttagtgacaagagggacatcgagacgtcggaagagc

SEQ ID NO: 39792 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgagggcgttagtgacaagagggacatcgagacgtcggaagagc

SEQ ID NO: 39793 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggaggttagtgacaagagggacatcgagacgtcggaagagc

SEQ ID NO: 39794 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgagagtgacaagagggacatcgagacgtcggaagagc

SEQ ID NO: 39795 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgaggacaagagggacatcgagacgtcggaagagc

SEQ ID NO: 39796 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgagaagagggacatcgagacgtcggaagagc

SEQ ID NO: 39797 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgagagggacatcgagacgtcggaagagc

SEQ ID NO: 39798 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggaggacatcgagacgtcggaagagc

SEQ ID NO: 39799 - RNA, 296 nt, synthetic construct
  source 1..296: mol_type = other RNA
cgctcttccgcgtctcatgtacgacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39800 - RNA, 296 nt, synthetic construct
  source 1..296: mol_type = other RNA
cgctcttccgcgtctcatgtacgtcgacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39801 - RNA, 296 nt, synthetic construct; identical to SEQ ID NO: 38380
  source 1..296: mol_type = other RNA

SEQ ID NO: 39802 - RNA, 296 nt, synthetic construct
  source 1..296: mol_type = other RNA
cgctcttccgcgtctcatgtacgtcggggacgaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39803 - RNA, 296 nt, synthetic construct
  source 1..296: mol_type = other RNA
cgctcttccgcgtctcatgtacgtcggggacgtcgacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39804 - RNA, 296 nt, synthetic construct
  source 1..296: mol_type = other RNA
cgctcttccgcgtctcatgtacgtcggggacgtccgcgacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39805 - RNA, 296 nt, synthetic construct
  source 1..296: mol_type = other RNA
cgctcttccgcgtctcatgtacgtcggggacgtccgcagcgacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39806 - RNA, 296 nt, synthetic construct
  source 1..296: mol_type = other RNA
cgctcttccgcgtctcatgtacgtcggggacgtccgcagcgtcgaccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39807 - RNA, 296 nt, synthetic construct
  source 1..296: mol_type = other RNA
cgctcttccgcgtctcatgtacgtcggggacgtccgcagcgtcacagacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39808 - RNA, 296 nt, synthetic construct
  source 1..296: mol_type = other RNA
cgctcttccgcgtctcatgtacgtcggggacgtccgcagcgtcacacaggaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39809 - RNA, 296 nt, synthetic construct
  source 1..296: mol_type = other RNA
cgctcttccgcgtctcatgtacgtcggggacgtccgcagcgtcacacagaaggacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39810 - RNA, 296 nt, synthetic construct
  source 1..296: mol_type = other RNA
cgctcttccgcgtctcatgtacgtcggggacgtccgcagcgtcacacagaagcatgaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39811 - RNA, 296 nt, synthetic construct
  source 1..296: mol_type = other RNA
cgctcttccgcgtctcatgtacgtcggggacgtccgcagcgtcacacagaagcatatcgacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39812 - RNA, 296 nt, synthetic construct
  source 1..296: mol_type = other RNA
cgctcttccgcgtctcatgtacgtcggggacgtccgcagcgtcacacagaagcatatccaggactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39813 - RNA, 296 nt, synthetic construct
  source 1..296: mol_type = other RNA
cgctcttccgcgtctcatgtacgtcggggacgtccgcagcgtcacacagaagcatatccaggaggacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39814 - RNA, 296 nt, synthetic construct
  source 1..296: mol_type = other RNA
cgctcttccgcgtctcatgtacgtcggggacgtccgcagcgtcacacagaagcatatccaggagtgggacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39815 - RNA, 296 nt, synthetic construct
  source 1..296: mol_type = other RNA
cgctcttccgcgtctcatgtacgtcggggacgtccgcagcgtcacacagaagcatatccaggagtggggcgacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39816 - RNA, 296 nt, synthetic construct
  source 1..296: mol_type = other RNA
cgctcttccgcgtctcatgtacgtcggggacgtccgcagcgtcacacagaagcatatccaggagtggggcccagacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39817 - RNA, 296 nt, synthetic construct; identical to SEQ ID NO: 38380
  source 1..296: mol_type = other RNA

SEQ ID NO: 39818 - RNA, 296 nt, synthetic construct
  source 1..296: mol_type = other RNA
cgctcttccgcgtctcatgtacgtcggggacgtccgcagcgtcacacagaagcatatccaggagtggggcccattcgacgacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39819 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39820 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtggacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39821 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattgacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39822 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggagacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39823 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcgacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39824 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtgactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39825 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccgacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39826 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcgacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39827 - RNA, 296 nt, synthetic construct; identical to SEQ ID NO: 38380
  source 1..296: mol_type = other RNA

SEQ ID NO: 39828 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacgactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39829 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcgacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39830 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccgacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39831 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39832 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39833 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39834 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39835 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39836 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39837 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39838 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39839 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39840 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39841 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39842 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39843 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39844 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39845 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39846 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39847 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39848 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39849 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39850 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39851 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgacctcctgcatgatgcgcggcccaaggagggagatgatcgccccttcttctggctctttgagaatgtggtggccatgggcgttagtgacaagagggacatcgagacgtcggaagagc

SEQ ID NO: 39852 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgacctgcatgatgcgcggcccaaggagggagatgatcgccccttcttctggctctttgagaatgtggtggccatgggcgttagtgacaagagggacatcgagacgtcggaagagc

SEQ ID NO: 39853 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgaccatgatgcgcggcccaaggagggagatgatcgccccttcttctggctctttgagaatgtggtggccatgggcgttagtgacaagagggacatcgagacgtcggaagagc

SEQ ID NO: 39854 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggacgatgcgcggcccaaggagggagatgatcgccccttcttctggctctttgagaatgtggtggccatgggcgttagtgacaagagggacatcgagacgtcggaagagc

SEQ ID NO: 39855 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgacgcgcggcccaaggagggagatgatcgccccttcttctggctctttgagaatgtggtggccatgggcgttagtgacaagagggacatcgagacgtcggaagagc

SEQ ID NO: 39856 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgaccggcccaaggagggagatgatcgccccttcttctggctctttgagaatgtggtggccatgggcgttagtgacaagagggacatcgagacgtcggaagagc

SEQ ID NO: 39857 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggaccccaaggagggagatgatcgccccttcttctggctctttgagaatgtggtggccatgggcgttagtgacaagagggacatcgagacgtcggaagagc

SEQ ID NO: 39858 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggacaaggagggagatgatcgccccttcttctggctctttgagaatgtggtggccatgggcgttagtgacaagagggacatcgagacgtcggaagagc

SEQ ID NO: 39859 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgacgagggagatgatcgccccttcttctggctctttgagaatgtggtggccatgggcgttagtgacaagagggacatcgagacgtcggaagagc

SEQ ID NO: 39860 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggacggagatgatcgccccttcttctggctctttgagaatgtggtggccatgggcgttagtgacaagagggacatcgagacgtcggaagagc

SEQ ID NO: 39861 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggacgatgatcgccccttcttctggctctttgagaatgtggtggccatgggcgttagtgacaagagggacatcgagacgtcggaagagc

SEQ ID NO: 39862 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagacgatcgccccttcttctggctctttgagaatgtggtggccatgggcgttagtgacaagagggacatcgagacgtcggaagagc

SEQ ID NO: 39863 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgaccgccccttcttctggctctttgagaatgtggtggccatgggcgttagtgacaagagggacatcgagacgtcggaagagc

SEQ ID NO: 39864 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgaccccttcttctggctctttgagaatgtggtggccatgggcgttagtgacaagagggacatcgagacgtcggaagagc

SEQ ID NO: 39865 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgacttcttctggctctttgagaatgtggtggccatgggcgttagtgacaagagggacatcgagacgtcggaagagc

SEQ ID NO: 39866 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgacttctggctctttgagaatgtggtggccatgggcgttagtgacaagagggacatcgagacgtcggaagagc

SEQ ID NO: 39867 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgactggctctttgagaatgtggtggccatgggcgttagtgacaagagggacatcgagacgtcggaagagc

SEQ ID NO: 39868 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgacctctttgagaatgtggtggccatgggcgttagtgacaagagggacatcgagacgtcggaagagc

SEQ ID NO: 39869 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggactttgagaatgtggtggccatgggcgttagtgacaagagggacatcgagacgtcggaagagc

SEQ ID NO: 39870 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgacgagaatgtggtggccatgggcgttagtgacaagagggacatcgagacgtcggaagagc

SEQ ID NO: 39871 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgacaatgtggtggccatgggcgttagtgacaagagggacatcgagacgtcggaagagc

SEQ ID NO: 39872 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggacgtggtggccatgggcgttagtgacaagagggacatcgagacgtcggaagagc

SEQ ID NO: 39873 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgacgtggccatgggcgttagtgacaagagggacatcgagacgtcggaagagc

SEQ ID NO: 39874 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggacgccatgggcgttagtgacaagagggacatcgagacgtcggaagagc

SEQ ID NO: 39875 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggacatgggcgttagtgacaagagggacatcgagacgtcggaagagc

SEQ ID NO: 39876 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgacggcgttagtgacaagagggacatcgagacgtcggaagagc

SEQ ID NO: 39877 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggacgttagtgacaagagggacatcgagacgtcggaagagc

SEQ ID NO: 39878 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgacagtgacaagagggacatcgagacgtcggaagagc

SEQ ID NO: 39879 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgacgacaagagggacatcgagacgtcggaagagc

SEQ ID NO: 39880 - RNA, 296 nt, synthetic construct; identical to SEQ ID NO: 38380
  source 1..296: mol_type = other RNA

SEQ ID NO: 39881 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgacagggacatcgagacgtcggaagagc

SEQ ID NO: 39882 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggacgacatcgagacgtcggaagagc

SEQ ID NO: 39883 - RNA, 296 nt, synthetic construct
  source 1..296: mol_type = other RNA
cgctcttccgcgtctcatgtacgtgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39884 - RNA, 296 nt, synthetic construct
  source 1..296: mol_type = other RNA
cgctcttccgcgtctcatgtacgtcgtggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39885 - RNA, 296 nt, synthetic construct
  source 1..296: mol_type = other RNA
cgctcttccgcgtctcatgtacgtcggggtggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39886 - RNA, 296 nt, synthetic construct
  source 1..296: mol_type = other RNA
cgctcttccgcgtctcatgtacgtcggggacgtgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39887 - RNA, 296 nt, synthetic construct
  source 1..296: mol_type = other RNA
cgctcttccgcgtctcatgtacgtcggggacgtcgtgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39888 - RNA, 296 nt, synthetic construct
  source 1..296: mol_type = other RNA
cgctcttccgcgtctcatgtacgtcggggacgtccgcgtggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39889 - RNA, 296 nt, synthetic construct
  source 1..296: mol_type = other RNA
cgctcttccgcgtctcatgtacgtcggggacgtccgcagcgtgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39890 - RNA, 296 nt, synthetic construct
  source 1..296: mol_type = other RNA
cgctcttccgcgtctcatgtacgtcggggacgtccgcagcgtcgtgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39891 - RNA, 296 nt, synthetic construct
  source 1..296: mol_type = other RNA
cgctcttccgcgtctcatgtacgtcggggacgtccgcagcgtcacagtgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39892 - RNA, 296 nt, synthetic construct
  source 1..296: mol_type = other RNA
cgctcttccgcgtctcatgtacgtcggggacgtccgcagcgtcacacaggtgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39893 - RNA, 296 nt, synthetic construct
  source 1..296: mol_type = other RNA
cgctcttccgcgtctcatgtacgtcggggacgtccgcagcgtcacacagaaggtgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39894 - RNA, 296 nt, synthetic construct
  source 1..296: mol_type = other RNA
cgctcttccgcgtctcatgtacgtcggggacgtccgcagcgtcacacagaagcatgtgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39895 - RNA, 296 nt, synthetic construct
  source 1..296: mol_type = other RNA
cgctcttccgcgtctcatgtacgtcggggacgtccgcagcgtcacacagaagcatatcgtggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39896 - RNA, 296 nt, synthetic construct
  source 1..296: mol_type = other RNA
cgctcttccgcgtctcatgtacgtcggggacgtccgcagcgtcacacagaagcatatccaggtgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39897 - RNA, 296 nt, synthetic construct
  source 1..296: mol_type = other RNA
cgctcttccgcgtctcatgtacgtcggggacgtccgcagcgtcacacagaagcatatccaggaggtgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39898 - RNA, 296 nt, synthetic construct
  source 1..296: mol_type = other RNA
cgctcttccgcgtctcatgtacgtcggggacgtccgcagcgtcacacagaagcatatccaggagtgggtgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39899 - RNA, 296 nt, synthetic construct
  source 1..296: mol_type = other RNA
cgctcttccgcgtctcatgtacgtcggggacgtccgcagcgtcacacagaagcatatccaggagtggggcgtgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39900 - RNA, 296 nt, synthetic construct
  source 1..296: mol_type = other RNA
cgctcttccgcgtctcatgtacgtcggggacgtccgcagcgtcacacagaagcatatccaggagtggggcccagtggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39901 - RNA, 296 nt, synthetic construct
  source 1..296: mol_type = other RNA
cgctcttccgcgtctcatgtacgtcggggacgtccgcagcgtcacacagaagcatatccaggagtggggcccattcgtgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39902 - RNA, 296 nt, synthetic construct
  source 1..296: mol_type = other RNA
cgctcttccgcgtctcatgtacgtcggggacgtccgcagcgtcacacagaagcatatccaggagtggggcccattcgacgtggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39903 - RNA, 296 nt, synthetic construct; identical to SEQ ID NO: 38380
  source 1..296: mol_type = other RNA

SEQ ID NO: 39904 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtggtgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39905 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattgtgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39906 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggagtgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39907 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcgtgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39908 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtgtgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39909 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccgtgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39910 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcgtggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39911 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgtgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39912 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacgtgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39913 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcgtgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39914 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccgtggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39915 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39916 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgtgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39917 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgtggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39918 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgtgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39919 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgtgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39920 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgtgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39921 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggtgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39922 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagtgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39923 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgtggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39924 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgtgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39925 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggtgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39926 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgtgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39927 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgtgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39928 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgtgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39929 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgtgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39930 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgtgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39931 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgtggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39932 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgtgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39933 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggtgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39934 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgtgcgcctcctgcatgatgcgcggcccaaggagggagatgatcgccccttcttctggctctttgagaatgtggtggccatgggcgttagtgacaagagggacatcgagacgtcggaagagc

SEQ ID NO: 39935 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgtgctcctgcatgatgcgcggcccaaggagggagatgatcgccccttcttctggctctttgagaatgtggtggccatgggcgttagtgacaagagggacatcgagacgtcggaagagc

SEQ ID NO: 39936 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgtgctgcatgatgcgcggcccaaggagggagatgatcgccccttcttctggctctttgagaatgtggtggccatgggcgttagtgacaagagggacatcgagacgtcggaagagc

SEQ ID NO: 39937 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgtgcatgatgcgcggcccaaggagggagatgatcgccccttcttctggctctttgagaatgtggtggccatgggcgttagtgacaagagggacatcgagacgtcggaagagc

SEQ ID NO: 39938 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggtggatgcgcggcccaaggagggagatgatcgccccttcttctggctctttgagaatgtggtggccatgggcgttagtgacaagagggacatcgagacgtcggaagagc

SEQ ID NO: 39939 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgtggcgcggcccaaggagggagatgatcgccccttcttctggctctttgagaatgtggtggccatgggcgttagtgacaagagggacatcgagacgtcggaagagc

SEQ ID NO: 39940 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgtgcggcccaaggagggagatgatcgccccttcttctggctctttgagaatgtggtggccatgggcgttagtgacaagagggacatcgagacgtcggaagagc

SEQ ID NO: 39941 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggtgcccaaggagggagatgatcgccccttcttctggctctttgagaatgtggtggccatgggcgttagtgacaagagggacatcgagacgtcggaagagc

SEQ ID NO: 39942 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggtgaaggagggagatgatcgccccttcttctggctctttgagaatgtggtggccatgggcgttagtgacaagagggacatcgagacgtcggaagagc

SEQ ID NO: 39943 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgtggagggagatgatcgccccttcttctggctctttgagaatgtggtggccatgggcgttagtgacaagagggacatcgagacgtcggaagagc

SEQ ID NO: 39944 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggtgggagatgatcgccccttcttctggctctttgagaatgtggtggccatgggcgttagtgacaagagggacatcgagacgtcggaagagc

SEQ ID NO: 39945 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggtggatgatcgccccttcttctggctctttgagaatgtggtggccatgggcgttagtgacaagagggacatcgagacgtcggaagagc

SEQ ID NO: 39946 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagtggatcgccccttcttctggctctttgagaatgtggtggccatgggcgttagtgacaagagggacatcgagacgtcggaagagc

SEQ ID NO: 39947 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgtgcgccccttcttctggctctttgagaatgtggtggccatgggcgttagtgacaagagggacatcgagacgtcggaagagc

SEQ ID NO: 39948 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgtgcccttcttctggctctttgagaatgtggtggccatgggcgttagtgacaagagggacatcgagacgtcggaagagc

SEQ ID NO: 39949 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgtgttcttctggctctttgagaatgtggtggccatgggcgttagtgacaagagggacatcgagacgtcggaagagc

SEQ ID NO: 39950 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgtgttctggctctttgagaatgtggtggccatgggcgttagtgacaagagggacatcgagacgtcggaagagc

SEQ ID NO: 39951 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgtgtggctctttgagaatgtggtggccatgggcgttagtgacaagagggacatcgagacgtcggaagagc

SEQ ID NO: 39952 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgtgctctttgagaatgtggtggccatgggcgttagtgacaagagggacatcgagacgtcggaagagc

SEQ ID NO: 39953 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggtgtttgagaatgtggtggccatgggcgttagtgacaagagggacatcgagacgtcggaagagc

SEQ ID NO: 39954 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgtggagaatgtggtggccatgggcgttagtgacaagagggacatcgagacgtcggaagagc

SEQ ID NO: 39955 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgtgaatgtggtggccatgggcgttagtgacaagagggacatcgagacgtcggaagagc

SEQ ID NO: 39956 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggtggtggtggccatgggcgttagtgacaagagggacatcgagacgtcggaagagc

SEQ ID NO: 39957 - RNA, 296 nt, synthetic construct; identical to SEQ ID NO: 38380
  source 1..296: mol_type = other RNA

SEQ ID NO: 39958 - RNA, 296 nt, synthetic construct; identical to SEQ ID NO: 38380
  source 1..296: mol_type = other RNA

SEQ ID NO: 39959 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggtgatgggcgttagtgacaagagggacatcgagacgtcggaagagc

SEQ ID NO: 39960 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgtgggcgttagtgacaagagggacatcgagacgtcggaagagc

SEQ ID NO: 39961 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggtggttagtgacaagagggacatcgagacgtcggaagagc

SEQ ID NO: 39962 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtgagtgacaagagggacatcgagacgtcggaagagc

SEQ ID NO: 39963 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgtggacaagagggacatcgagacgtcggaagagc

SEQ ID NO: 39964 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgtgaagagggacatcgagacgtcggaagagc

SEQ ID NO: 39965 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgtgagggacatcgagacgtcggaagagc

SEQ ID NO: 39966 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggtggacatcgagacgtcggaagagc

SEQ ID NO: 39967 - RNA, 296 nt, synthetic construct; identical to SEQ ID NO: 38380
  source 1..296: mol_type = other RNA

SEQ ID NO: 39968 - RNA, 296 nt, synthetic construct
  source 1..296: mol_type = other RNA
cgctcttccgcgtctcatgtacgtcgtcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39969 - RNA, 296 nt, synthetic construct
  source 1..296: mol_type = other RNA
cgctcttccgcgtctcatgtacgtcggggtcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39970 - RNA, 296 nt, synthetic construct; identical to SEQ ID NO: 38380
  source 1..296: mol_type = other RNA

SEQ ID NO: 39971 - RNA, 296 nt, synthetic construct
  source 1..296: mol_type = other RNA
cgctcttccgcgtctcatgtacgtcggggacgtcgtcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39972 - RNA, 296 nt, synthetic construct
  source 1..296: mol_type = other RNA
cgctcttccgcgtctcatgtacgtcggggacgtccgcgtcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39973 - RNA, 296 nt, synthetic construct; identical to SEQ ID NO: 38380
  source 1..296: mol_type = other RNA

SEQ ID NO: 39974 - RNA, 296 nt, synthetic construct
  source 1..296: mol_type = other RNA
cgctcttccgcgtctcatgtacgtcggggacgtccgcagcgtcgtccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39975 - RNA, 296 nt, synthetic construct
  source 1..296: mol_type = other RNA
cgctcttccgcgtctcatgtacgtcggggacgtccgcagcgtcacagtcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39976 - RNA, 296 nt, synthetic construct
  source 1..296: mol_type = other RNA
cgctcttccgcgtctcatgtacgtcggggacgtccgcagcgtcacacaggtccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39977 - RNA, 296 nt, synthetic construct
  source 1..296: mol_type = other RNA
cgctcttccgcgtctcatgtacgtcggggacgtccgcagcgtcacacagaaggtcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39978 - RNA, 296 nt, synthetic construct
  source 1..296: mol_type = other RNA
cgctcttccgcgtctcatgtacgtcggggacgtccgcagcgtcacacagaagcatgtccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39979 - RNA, 296 nt, synthetic construct
  source 1..296: mol_type = other RNA
cgctcttccgcgtctcatgtacgtcggggacgtccgcagcgtcacacagaagcatatcgtcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39980 - RNA, 296 nt, synthetic construct
  source 1..296: mol_type = other RNA
cgctcttccgcgtctcatgtacgtcggggacgtccgcagcgtcacacagaagcatatccaggtctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39981 - RNA, 296 nt, synthetic construct
  source 1..296: mol_type = other RNA
cgctcttccgcgtctcatgtacgtcggggacgtccgcagcgtcacacagaagcatatccaggaggtcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39982 - RNA, 296 nt, synthetic construct
  source 1..296: mol_type = other RNA
cgctcttccgcgtctcatgtacgtcggggacgtccgcagcgtcacacagaagcatatccaggagtgggtcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39983 - RNA, 296 nt, synthetic construct
  source 1..296: mol_type = other RNA
cgctcttccgcgtctcatgtacgtcggggacgtccgcagcgtcacacagaagcatatccaggagtggggcgtcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39984 - RNA, 296 nt, synthetic construct
  source 1..296: mol_type = other RNA
cgctcttccgcgtctcatgtacgtcggggacgtccgcagcgtcacacagaagcatatccaggagtggggcccagtcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39985 - RNA, 296 nt, synthetic construct
  source 1..296: mol_type = other RNA
cgctcttccgcgtctcatgtacgtcggggacgtccgcagcgtcacacagaagcatatccaggagtggggcccattcgtcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39986 - RNA, 296 nt, synthetic construct
  source 1..296: mol_type = other RNA
cgctcttccgcgtctcatgtacgtcggggacgtccgcagcgtcacacagaagcatatccaggagtggggcccattcgacgtcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39987 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39988 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtggtcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39989 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattgtcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39990 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggagtcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39991 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcgtcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39992 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtgtctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39993 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccgtcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39994 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcgtcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39995 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgtcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39996 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacgtctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39997 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcgtcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39998 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccgtcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 39999 - RNA, 296 nt, synthetic construct; identical to SEQ ID NO: 38380
  source 1..296: mol_type = other RNA

SEQ ID NO: 40000 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgtccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40001 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgtcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40002 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgtccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40003 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgtcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40004 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgtcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40005 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggtcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40006 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagtctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40007 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgtcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40008 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgtcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40009 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggtcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40010 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgtcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40011 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgtccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40012 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgtcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40013 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgtcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40014 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgtctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40015 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgtcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40016 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgtcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40017 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggtctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40018 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgtccgcctcctgcatgatgcgcggcccaaggagggagatgatcgccccttcttctggctctttgagaatgtggtggccatgggcgttagtgacaagagggacatcgagacgtcggaagagc

SEQ ID NO: 40019 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgtcctcctgcatgatgcgcggcccaaggagggagatgatcgccccttcttctggctctttgagaatgtggtggccatgggcgttagtgacaagagggacatcgagacgtcggaagagc

SEQ ID NO: 40020 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgtcctgcatgatgcgcggcccaaggagggagatgatcgccccttcttctggctctttgagaatgtggtggccatgggcgttagtgacaagagggacatcgagacgtcggaagagc

SEQ ID NO: 40021 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgtccatgatgcgcggcccaaggagggagatgatcgccccttcttctggctctttgagaatgtggtggccatgggcgttagtgacaagagggacatcgagacgtcggaagagc

SEQ ID NO: 40022 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggtcgatgcgcggcccaaggagggagatgatcgccccttcttctggctctttgagaatgtggtggccatgggcgttagtgacaagagggacatcgagacgtcggaagagc

SEQ ID NO: 40023 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgtcgcgcggcccaaggagggagatgatcgccccttcttctggctctttgagaatgtggtggccatgggcgttagtgacaagagggacatcgagacgtcggaagagc

SEQ ID NO: 40024 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgtccggcccaaggagggagatgatcgccccttcttctggctctttgagaatgtggtggccatgggcgttagtgacaagagggacatcgagacgtcggaagagc

SEQ ID NO: 40025 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggtccccaaggagggagatgatcgccccttcttctggctctttgagaatgtggtggccatgggcgttagtgacaagagggacatcgagacgtcggaagagc

SEQ ID NO: 40026 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggtcaaggagggagatgatcgccccttcttctggctctttgagaatgtggtggccatgggcgttagtgacaagagggacatcgagacgtcggaagagc

SEQ ID NO: 40027 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgtcgagggagatgatcgccccttcttctggctctttgagaatgtggtggccatgggcgttagtgacaagagggacatcgagacgtcggaagagc

SEQ ID NO: 40028 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggtcggagatgatcgccccttcttctggctctttgagaatgtggtggccatgggcgttagtgacaagagggacatcgagacgtcggaagagc

SEQ ID NO: 40029 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggtcgatgatcgccccttcttctggctctttgagaatgtggtggccatgggcgttagtgacaagagggacatcgagacgtcggaagagc

SEQ ID NO: 40030 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagtcgatcgccccttcttctggctctttgagaatgtggtggccatgggcgttagtgacaagagggacatcgagacgtcggaagagc

SEQ ID NO: 40031 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgtccgccccttcttctggctctttgagaatgtggtggccatgggcgttagtgacaagagggacatcgagacgtcggaagagc

SEQ ID NO: 40032 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgtccccttcttctggctctttgagaatgtggtggccatgggcgttagtgacaagagggacatcgagacgtcggaagagc

SEQ ID NO: 40033 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgtcttcttctggctctttgagaatgtggtggccatgggcgttagtgacaagagggacatcgagacgtcggaagagc

SEQ ID NO: 40034 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgtcttctggctctttgagaatgtggtggccatgggcgttagtgacaagagggacatcgagacgtcggaagagc

SEQ ID NO: 40035 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgtctggctctttgagaatgtggtggccatgggcgttagtgacaagagggacatcgagacgtcggaagagc

SEQ ID NO: 40036 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgtcctctttgagaatgtggtggccatgggcgttagtgacaagagggacatcgagacgtcggaagagc

SEQ ID NO: 40037 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggtctttgagaatgtggtggccatgggcgttagtgacaagagggacatcgagacgtcggaagagc

SEQ ID NO: 40038 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgtcgagaatgtggtggccatgggcgttagtgacaagagggacatcgagacgtcggaagagc

SEQ ID NO: 40039 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgtcaatgtggtggccatgggcgttagtgacaagagggacatcgagacgtcggaagagc

SEQ ID NO: 40040 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggtcgtggtggccatgggcgttagtgacaagagggacatcgagacgtcggaagagc

SEQ ID NO: 40041 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtcgtggccatgggcgttagtgacaagagggacatcgagacgtcggaagagc

SEQ ID NO: 40042 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtcgccatgggcgttagtgacaagagggacatcgagacgtcggaagagc

SEQ ID NO: 40043 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggtcatgggcgttagtgacaagagggacatcgagacgtcggaagagc

SEQ ID NO: 40044 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgtcggcgttagtgacaagagggacatcgagacgtcggaagagc

SEQ ID NO: 40045 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggtcgttagtgacaagagggacatcgagacgtcggaagagc

SEQ ID NO: 40046 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtcagtgacaagagggacatcgagacgtcggaagagc

SEQ ID NO: 40047 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgtcgacaagagggacatcgagacgtcggaagagc

SEQ ID NO: 40048 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgtcaagagggacatcgagacgtcggaagagc

SEQ ID NO: 40049 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgtcagggacatcgagacgtcggaagagc

SEQ ID NO: 40050 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggtcgacatcgagacgtcggaagagc

SEQ ID NO: 40051 - RNA, 296 nt, synthetic construct
  source 1..296: mol_type = other RNA
cgctcttccgcgtctcatgtacgggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40052 - RNA, 296 nt, synthetic construct; identical to SEQ ID NO: 38380
  source 1..296: mol_type = other RNA

SEQ ID NO: 40053 - RNA, 296 nt, synthetic construct
  source 1..296: mol_type = other RNA
cgctcttccgcgtctcatgtacgtcgggggggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40054 - RNA, 296 nt, synthetic construct
  source 1..296: mol_type = other RNA
cgctcttccgcgtctcatgtacgtcggggacgggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40055 - RNA, 296 nt, synthetic construct
  source 1..296: mol_type = other RNA
cgctcttccgcgtctcatgtacgtcggggacgtcgggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40056 - RNA, 296 nt, synthetic construct
  source 1..296: mol_type = other RNA
cgctcttccgcgtctcatgtacgtcggggacgtccgcggggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40057 - RNA, 296 nt, synthetic construct
  source 1..296: mol_type = other RNA
cgctcttccgcgtctcatgtacgtcggggacgtccgcagcgggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40058 - RNA, 296 nt, synthetic construct
  source 1..296: mol_type = other RNA
cgctcttccgcgtctcatgtacgtcggggacgtccgcagcgtcgggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40059 - RNA, 296 nt, synthetic construct
  source 1..296: mol_type = other RNA
cgctcttccgcgtctcatgtacgtcggggacgtccgcagcgtcacagggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40060 - RNA, 296 nt, synthetic construct
  source 1..296: mol_type = other RNA
cgctcttccgcgtctcatgtacgtcggggacgtccgcagcgtcacacaggggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40061 - RNA, 296 nt, synthetic construct
  source 1..296: mol_type = other RNA
cgctcttccgcgtctcatgtacgtcggggacgtccgcagcgtcacacagaaggggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40062 - RNA, 296 nt, synthetic construct
  source 1..296: mol_type = other RNA
cgctcttccgcgtctcatgtacgtcggggacgtccgcagcgtcacacagaagcatgggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40063 - RNA, 296 nt, synthetic construct
  source 1..296: mol_type = other RNA
cgctcttccgcgtctcatgtacgtcggggacgtccgcagcgtcacacagaagcatatcggggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40064 - RNA, 296 nt, synthetic construct
  source 1..296: mol_type = other RNA
cgctcttccgcgtctcatgtacgtcggggacgtccgcagcgtcacacagaagcatatccaggggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40065 - RNA, 296 nt, synthetic construct
  source 1..296: mol_type = other RNA
cgctcttccgcgtctcatgtacgtcggggacgtccgcagcgtcacacagaagcatatccaggaggggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40066 - RNA, 296 nt, synthetic construct
  source 1..296: mol_type = other RNA
cgctcttccgcgtctcatgtacgtcggggacgtccgcagcgtcacacagaagcatatccaggagtgggggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40067 - RNA, 296 nt, synthetic construct
  source 1..296: mol_type = other RNA
cgctcttccgcgtctcatgtacgtcggggacgtccgcagcgtcacacagaagcatatccaggagtggggcgggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40068 - RNA, 296 nt, synthetic construct
  source 1..296: mol_type = other RNA
cgctcttccgcgtctcatgtacgtcggggacgtccgcagcgtcacacagaagcatatccaggagtggggcccaggggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40069 - RNA, 296 nt, synthetic construct
  source 1..296: mol_type = other RNA
cgctcttccgcgtctcatgtacgtcggggacgtccgcagcgtcacacagaagcatatccaggagtggggcccattcgggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40070 - RNA, 296 nt, synthetic construct
  source 1..296: mol_type = other RNA
cgctcttccgcgtctcatgtacgtcggggacgtccgcagcgtcacacagaagcatatccaggagtggggcccattcgacggggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40071 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40072 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtggggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40073 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattgggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40074 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggagggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40075 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcgggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40076 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtgggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40077 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccgggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40078 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcggggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40079 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40080 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacgggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40081 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcgggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40082 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccggggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40083 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40084 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40085 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacggggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40086 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40087 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40088 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40089 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40090 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40091 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttggggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40092 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40093 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40094 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40095 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40096 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40097 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40098 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40099 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcggggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40100 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40101 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40102 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgggcgcctcctgcatgatgcgcggcccaaggagggagatgatcgccccttcttctggctctttgagaatgtggtggccatgggcgttagtgacaagagggacatcgagacgtcggaagagc

SEQ ID NO: 40103 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgggctcctgcatgatgcgcggcccaaggagggagatgatcgccccttcttctggctctttgagaatgtggtggccatgggcgttagtgacaagagggacatcgagacgtcggaagagc

SEQ ID NO: 40104 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgggctgcatgatgcgcggcccaaggagggagatgatcgccccttcttctggctctttgagaatgtggtggccatgggcgttagtgacaagagggacatcgagacgtcggaagagc

SEQ ID NO: 40105 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgggcatgatgcgcggcccaaggagggagatgatcgccccttcttctggctctttgagaatgtggtggccatgggcgttagtgacaagagggacatcgagacgtcggaagagc

SEQ ID NO: 40106 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgggggatgcgcggcccaaggagggagatgatcgccccttcttctggctctttgagaatgtggtggccatgggcgttagtgacaagagggacatcgagacgtcggaagagc

SEQ ID NO: 40107 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatggggcgcggcccaaggagggagatgatcgccccttcttctggctctttgagaatgtggtggccatgggcgttagtgacaagagggacatcgagacgtcggaagagc

SEQ ID NO: 40108 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgggcggcccaaggagggagatgatcgccccttcttctggctctttgagaatgtggtggccatgggcgttagtgacaagagggacatcgagacgtcggaagagc

SEQ ID NO: 40109 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggggcccaaggagggagatgatcgccccttcttctggctctttgagaatgtggtggccatgggcgttagtgacaagagggacatcgagacgtcggaagagc

SEQ ID NO: 40110 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggggaaggagggagatgatcgccccttcttctggctctttgagaatgtggtggccatgggcgttagtgacaagagggacatcgagacgtcggaagagc

SEQ ID NO: 40111 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccggggagggagatgatcgccccttcttctggctctttgagaatgtggtggccatgggcgttagtgacaagagggacatcgagacgtcggaagagc

SEQ ID NO: 40112 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggggggagatgatcgccccttcttctggctctttgagaatgtggtggccatgggcgttagtgacaagagggacatcgagacgtcggaagagc

SEQ ID NO: 40113 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggggatgatcgccccttcttctggctctttgagaatgtggtggccatgggcgttagtgacaagagggacatcgagacgtcggaagagc

SEQ ID NO: 40114 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaggggatcgccccttcttctggctctttgagaatgtggtggccatgggcgttagtgacaagagggacatcgagacgtcggaagagc

SEQ ID NO: 40115 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgggcgccccttcttctggctctttgagaatgtggtggccatgggcgttagtgacaagagggacatcgagacgtcggaagagc

SEQ ID NO: 40116 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgggcccttcttctggctctttgagaatgtggtggccatgggcgttagtgacaagagggacatcgagacgtcggaagagc

SEQ ID NO: 40117 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgggttcttctggctctttgagaatgtggtggccatgggcgttagtgacaagagggacatcgagacgtcggaagagc

SEQ ID NO: 40118 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgggttctggctctttgagaatgtggtggccatgggcgttagtgacaagagggacatcgagacgtcggaagagc

SEQ ID NO: 40119 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgggtggctctttgagaatgtggtggccatgggcgttagtgacaagagggacatcgagacgtcggaagagc

SEQ ID NO: 40120 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgggctctttgagaatgtggtggccatgggcgttagtgacaagagggacatcgagacgtcggaagagc

SEQ ID NO: 40121 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggggtttgagaatgtggtggccatgggcgttagtgacaagagggacatcgagacgtcggaagagc

SEQ ID NO: 40122 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcggggagaatgtggtggccatgggcgttagtgacaagagggacatcgagacgtcggaagagc

SEQ ID NO: 40123 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgggaatgtggtggccatgggcgttagtgacaagagggacatcgagacgtcggaagagc

SEQ ID NO: 40124 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagggggtggtggccatgggcgttagtgacaagagggacatcgagacgtcggaagagc

SEQ ID NO: 40125 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatggggtggccatgggcgttagtgacaagagggacatcgagacgtcggaagagc

SEQ ID NO: 40126 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgggggccatgggcgttagtgacaagagggacatcgagacgtcggaagagc

SEQ ID NO: 40127 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggggatgggcgttagtgacaagagggacatcgagacgtcggaagagc

SEQ ID NO: 40128 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgggggcgttagtgacaagagggacatcgagacgtcggaagagc

SEQ ID NO: 40129 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggggttagtgacaagagggacatcgagacgtcggaagagc

SEQ ID NO: 40130 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgggagtgacaagagggacatcgagacgtcggaagagc

SEQ ID NO: 40131 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttggggacaagagggacatcgagacgtcggaagagc

SEQ ID NO: 40132 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgggaagagggacatcgagacgtcggaagagc

SEQ ID NO: 40133 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgggagggacatcgagacgtcggaagagc

SEQ ID NO: 40134 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagggggacatcgagacgtcggaagagc

SEQ ID NO: 40135 - RNA, 296 nt, synthetic construct
  source 1..296: mol_type = other RNA
cgctcttccgcgtctcatgtacggcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40136 - RNA, 296 nt, synthetic construct
  source 1..296: mol_type = other RNA
cgctcttccgcgtctcatgtacgtcggcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40137 - RNA, 296 nt, synthetic construct
  source 1..296: mol_type = other RNA
cgctcttccgcgtctcatgtacgtcgggggcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40138 - RNA, 296 nt, synthetic construct
  source 1..296: mol_type = other RNA
cgctcttccgcgtctcatgtacgtcggggacggccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40139 - RNA, 296 nt, synthetic construct
  source 1..296: mol_type = other RNA
cgctcttccgcgtctcatgtacgtcggggacgtcggcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40140 - RNA, 296 nt, synthetic construct
  source 1..296: mol_type = other RNA
cgctcttccgcgtctcatgtacgtcggggacgtccgcggcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40141 - RNA, 296 nt, synthetic construct
  source 1..296: mol_type = other RNA
cgctcttccgcgtctcatgtacgtcggggacgtccgcagcggcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40142 - RNA, 296 nt, synthetic construct
  source 1..296: mol_type = other RNA
cgctcttccgcgtctcatgtacgtcggggacgtccgcagcgtcggccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40143 - RNA, 296 nt, synthetic construct
  source 1..296: mol_type = other RNA
cgctcttccgcgtctcatgtacgtcggggacgtccgcagcgtcacaggcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40144 - RNA, 296 nt, synthetic construct
  source 1..296: mol_type = other RNA
cgctcttccgcgtctcatgtacgtcggggacgtccgcagcgtcacacagggccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40145 - RNA, 296 nt, synthetic construct
  source 1..296: mol_type = other RNA
cgctcttccgcgtctcatgtacgtcggggacgtccgcagcgtcacacagaagggcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40146 - RNA, 296 nt, synthetic construct
  source 1..296: mol_type = other RNA
cgctcttccgcgtctcatgtacgtcggggacgtccgcagcgtcacacagaagcatggccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40147 - RNA, 296 nt, synthetic construct
  source 1..296: mol_type = other RNA
cgctcttccgcgtctcatgtacgtcggggacgtccgcagcgtcacacagaagcatatcggcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40148 - RNA, 296 nt, synthetic construct
  source 1..296: mol_type = other RNA
cgctcttccgcgtctcatgtacgtcggggacgtccgcagcgtcacacagaagcatatccagggctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40149 - RNA, 296 nt, synthetic construct
  source 1..296: mol_type = other RNA
cgctcttccgcgtctcatgtacgtcggggacgtccgcagcgtcacacagaagcatatccaggagggcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40150 - RNA, 296 nt, synthetic construct; identical to SEQ ID NO: 38380
  source 1..296: mol_type = other RNA

SEQ ID NO: 40151 - RNA, 296 nt, synthetic construct
  source 1..296: mol_type = other RNA
cgctcttccgcgtctcatgtacgtcggggacgtccgcagcgtcacacagaagcatatccaggagtggggcggcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40152 - RNA, 296 nt, synthetic construct
  source 1..296: mol_type = other RNA
cgctcttccgcgtctcatgtacgtcggggacgtccgcagcgtcacacagaagcatatccaggagtggggcccaggcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40153 - RNA, 296 nt, synthetic construct
  source 1..296: mol_type = other RNA
cgctcttccgcgtctcatgtacgtcggggacgtccgcagcgtcacacagaagcatatccaggagtggggcccattcggcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40154 - RNA, 296 nt, synthetic construct
  source 1..296: mol_type = other RNA
cgctcttccgcgtctcatgtacgtcggggacgtccgcagcgtcacacagaagcatatccaggagtggggcccattcgacggcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40155 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgggcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40156 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgggcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40157 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40158 - RNA, 296 nt, synthetic construct; identical to SEQ ID NO: 38380
  source 1..296: mol_type = other RNA

SEQ ID NO: 40159 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcggcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40160 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtggctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40161 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccggcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40162 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcggcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40163 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacggcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40164 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacggctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40165 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcggcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40166 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccggcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40167 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattggcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40168 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcggccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40169 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacggcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40170 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctggccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40171 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccggcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40172 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcggcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40173 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40174 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaggctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40175 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttggcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40176 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatggcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40177 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40178 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtggcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40179 - RNA, 296 nt, synthetic construct; identical to SEQ ID NO: 38380
  source 1..296: mol_type = other RNA

SEQ ID NO: 40180 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcggcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40181 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcggcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40182 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcggctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40183 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcggcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40184 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttggcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40185 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagggctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40186 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcggccgcctcctgcatgatgcgcggcccaaggagggagatgatcgccccttcttctggctctttgagaatgtggtggccatgggcgttagtgacaagagggacatcgagacgtcggaagagc

SEQ ID NO: 40187 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacggcctcctgcatgatgcgcggcccaaggagggagatgatcgccccttcttctggctctttgagaatgtggtggccatgggcgttagtgacaagagggacatcgagacgtcggaagagc

SEQ ID NO: 40188 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcggcctgcatgatgcgcggcccaaggagggagatgatcgccccttcttctggctctttgagaatgtggtggccatgggcgttagtgacaagagggacatcgagacgtcggaagagc

SEQ ID NO: 40189 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcggccatgatgcgcggcccaaggagggagatgatcgccccttcttctggctctttgagaatgtggtggccatgggcgttagtgacaagagggacatcgagacgtcggaagagc

SEQ ID NO: 40190 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgggcgatgcgcggcccaaggagggagatgatcgccccttcttctggctctttgagaatgtggtggccatgggcgttagtgacaagagggacatcgagacgtcggaagagc

SEQ ID NO: 40191 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatggcgcgcggcccaaggagggagatgatcgccccttcttctggctctttgagaatgtggtggccatgggcgttagtgacaagagggacatcgagacgtcggaagagc

SEQ ID NO: 40192 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatggccggcccaaggagggagatgatcgccccttcttctggctctttgagaatgtggtggccatgggcgttagtgacaagagggacatcgagacgtcggaagagc

SEQ ID NO: 40193 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgggccccaaggagggagatgatcgccccttcttctggctctttgagaatgtggtggccatgggcgttagtgacaagagggacatcgagacgtcggaagagc

SEQ ID NO: 40194 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggggcaaggagggagatgatcgccccttcttctggctctttgagaatgtggtggccatgggcgttagtgacaagagggacatcgagacgtcggaagagc

SEQ ID NO: 40195 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccggcgagggagatgatcgccccttcttctggctctttgagaatgtggtggccatgggcgttagtgacaagagggacatcgagacgtcggaagagc

SEQ ID NO: 40196 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagggcggagatgatcgccccttcttctggctctttgagaatgtggtggccatgggcgttagtgacaagagggacatcgagacgtcggaagagc

SEQ ID NO: 40197 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggcgatgatcgccccttcttctggctctttgagaatgtggtggccatgggcgttagtgacaagagggacatcgagacgtcggaagagc

SEQ ID NO: 40198 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaggcgatcgccccttcttctggctctttgagaatgtggtggccatgggcgttagtgacaagagggacatcgagacgtcggaagagc

SEQ ID NO: 40199 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatggccgccccttcttctggctctttgagaatgtggtggccatgggcgttagtgacaagagggacatcgagacgtcggaagagc

SEQ ID NO: 40200 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatggccccttcttctggctctttgagaatgtggtggccatgggcgttagtgacaagagggacatcgagacgtcggaagagc

SEQ ID NO: 40201 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcggcttcttctggctctttgagaatgtggtggccatgggcgttagtgacaagagggacatcgagacgtcggaagagc

SEQ ID NO: 40202 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccggcttctggctctttgagaatgtggtggccatgggcgttagtgacaagagggacatcgagacgtcggaagagc

SEQ ID NO: 40203 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcggctggctctttgagaatgtggtggccatgggcgttagtgacaagagggacatcgagacgtcggaagagc

SEQ ID NO: 40204 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcggcctctttgagaatgtggtggccatgggcgttagtgacaagagggacatcgagacgtcggaagagc

SEQ ID NO: 40205 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggggctttgagaatgtggtggccatgggcgttagtgacaagagggacatcgagacgtcggaagagc

SEQ ID NO: 40206 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcggcgagaatgtggtggccatgggcgttagtgacaagagggacatcgagacgtcggaagagc

SEQ ID NO: 40207 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttggcaatgtggtggccatgggcgttagtgacaagagggacatcgagacgtcggaagagc

SEQ ID NO: 40208 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagggcgtggtggccatgggcgttagtgacaagagggacatcgagacgtcggaagagc

SEQ ID NO: 40209 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatggcgtggccatgggcgttagtgacaagagggacatcgagacgtcggaagagc

SEQ ID NO: 40210 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgggcgccatgggcgttagtgacaagagggacatcgagacgtcggaagagc

SEQ ID NO: 40211 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgggcatgggcgttagtgacaagagggacatcgagacgtcggaagagc

SEQ ID NO: 40212 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccggcggcgttagtgacaagagggacatcgagacgtcggaagagc

SEQ ID NO: 40213 - RNA, 296 nt, synthetic construct; identical to SEQ ID NO: 38380
  source 1..296: mol_type = other RNA

SEQ ID NO: 40214 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcggcagtgacaagagggacatcgagacgtcggaagagc

SEQ ID NO: 40215 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttggcgacaagagggacatcgagacgtcggaagagc

SEQ ID NO: 40216 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtggcaagagggacatcgagacgtcggaagagc

SEQ ID NO: 40217 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacggcagggacatcgagacgtcggaagagc

SEQ ID NO: 40218 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagggcgacatcgagacgtcggaagagc

SEQ ID NO: 40219 - RNA, 296 nt, synthetic construct
  source 1..296: mol_type = other RNA
cgctcttccgcgtctcatgtacgcgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40220 - RNA, 296 nt, synthetic construct
  source 1..296: mol_type = other RNA
cgctcttccgcgtctcatgtacgtcgcggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40221 - RNA, 296 nt, synthetic construct
  source 1..296: mol_type = other RNA
cgctcttccgcgtctcatgtacgtcggggcggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40222 - RNA, 296 nt, synthetic construct
  source 1..296: mol_type = other RNA
cgctcttccgcgtctcatgtacgtcggggacgcgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40223 - RNA, 296 nt, synthetic construct
  source 1..296: mol_type = other RNA
cgctcttccgcgtctcatgtacgtcggggacgtcgcgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40224 - RNA, 296 nt, synthetic construct
  source 1..296: mol_type = other RNA
cgctcttccgcgtctcatgtacgtcggggacgtccgcgcggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40225 - RNA, 296 nt, synthetic construct
  source 1..296: mol_type = other RNA
cgctcttccgcgtctcatgtacgtcggggacgtccgcagcgcgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40226 - RNA, 296 nt, synthetic construct
  source 1..296: mol_type = other RNA
cgctcttccgcgtctcatgtacgtcggggacgtccgcagcgtcgcgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40227 - RNA, 296 nt, synthetic construct
  source 1..296: mol_type = other RNA
cgctcttccgcgtctcatgtacgtcggggacgtccgcagcgtcacagcgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40228 - RNA, 296 nt, synthetic construct
  source 1..296: mol_type = other RNA
cgctcttccgcgtctcatgtacgtcggggacgtccgcagcgtcacacaggcgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40229 - RNA, 296 nt, synthetic construct
  source 1..296: mol_type = other RNA
cgctcttccgcgtctcatgtacgtcggggacgtccgcagcgtcacacagaaggcgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40230 - RNA, 296 nt, synthetic construct
  source 1..296: mol_type = other RNA
cgctcttccgcgtctcatgtacgtcggggacgtccgcagcgtcacacagaagcatgcgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40231 - RNA, 296 nt, synthetic construct
  source 1..296: mol_type = other RNA
cgctcttccgcgtctcatgtacgtcggggacgtccgcagcgtcacacagaagcatatcgcggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40232 - RNA, 296 nt, synthetic construct
  source 1..296: mol_type = other RNA
cgctcttccgcgtctcatgtacgtcggggacgtccgcagcgtcacacagaagcatatccaggcgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40233 - RNA, 296 nt, synthetic construct
  source 1..296: mol_type = other RNA
cgctcttccgcgtctcatgtacgtcggggacgtccgcagcgtcacacagaagcatatccaggaggcgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40234 - RNA, 296 nt, synthetic construct
  source 1..296: mol_type = other RNA
cgctcttccgcgtctcatgtacgtcggggacgtccgcagcgtcacacagaagcatatccaggagtgggcgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40235 - RNA, 296 nt, synthetic construct
  source 1..296: mol_type = other RNA
cgctcttccgcgtctcatgtacgtcggggacgtccgcagcgtcacacagaagcatatccaggagtggggcgcgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40236 - RNA, 296 nt, synthetic construct
  source 1..296: mol_type = other RNA
cgctcttccgcgtctcatgtacgtcggggacgtccgcagcgtcacacagaagcatatccaggagtggggcccagcggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40237 - RNA, 296 nt, synthetic construct
  source 1..296: mol_type = other RNA
cgctcttccgcgtctcatgtacgtcggggacgtccgcagcgtcacacagaagcatatccaggagtggggcccattcgcgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40238 - RNA, 296 nt, synthetic construct
  source 1..296: mol_type = other RNA
cgctcttccgcgtctcatgtacgtcggggacgtccgcagcgtcacacagaagcatatccaggagtggggcccattcgacgcggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40239 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggcgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40240 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtggcgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40241 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattgcgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40242 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggagcgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40243 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcgcgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40244 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtgcgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40245 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccgcgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40246 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcgcggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40247 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgcgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40248 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacgcgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40249 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcgcgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40250 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccgcggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40251 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgcgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40252 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgcgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40253 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgcggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40254 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40255 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgcgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40256 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgcgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40257 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggcgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40258 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagcgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40259 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgcggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40260 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgcgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40261 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggcgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40262 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgcgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40263 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgcgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40264 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgcgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40265 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgcgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40266 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgcgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40267 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgcggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40268 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgcgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40269 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggcgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40270 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgcgcgcctcctgcatgatgcgcggcccaaggagggagatgatcgccccttcttctggctctttgagaatgtggtggccatgggcgttagtgacaagagggacatcgagacgtcggaagagc

SEQ ID NO: 40271 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgcgctcctgcatgatgcgcggcccaaggagggagatgatcgccccttcttctggctctttgagaatgtggtggccatgggcgttagtgacaagagggacatcgagacgtcggaagagc

SEQ ID NO: 40272 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgcgctgcatgatgcgcggcccaaggagggagatgatcgccccttcttctggctctttgagaatgtggtggccatgggcgttagtgacaagagggacatcgagacgtcggaagagc

SEQ ID NO: 40273 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgcgcatgatgcgcggcccaaggagggagatgatcgccccttcttctggctctttgagaatgtggtggccatgggcgttagtgacaagagggacatcgagacgtcggaagagc

SEQ ID NO: 40274 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggcggatgcgcggcccaaggagggagatgatcgccccttcttctggctctttgagaatgtggtggccatgggcgttagtgacaagagggacatcgagacgtcggaagagc

SEQ ID NO: 40275 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgcggcgcggcccaaggagggagatgatcgccccttcttctggctctttgagaatgtggtggccatgggcgttagtgacaagagggacatcgagacgtcggaagagc

SEQ ID NO: 40276 - RNA, 296 nt, synthetic construct; identical to SEQ ID NO: 38380
  source 1..296: mol_type = other RNA

SEQ ID NO: 40277 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggcgcccaaggagggagatgatcgccccttcttctggctctttgagaatgtggtggccatgggcgttagtgacaagagggacatcgagacgtcggaagagc

SEQ ID NO: 40278 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggcgaaggagggagatgatcgccccttcttctggctctttgagaatgtggtggccatgggcgttagtgacaagagggacatcgagacgtcggaagagc

SEQ ID NO: 40279 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgcggagggagatgatcgccccttcttctggctctttgagaatgtggtggccatgggcgttagtgacaagagggacatcgagacgtcggaagagc

SEQ ID NO: 40280 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggcgggagatgatcgccccttcttctggctctttgagaatgtggtggccatgggcgttagtgacaagagggacatcgagacgtcggaagagc

SEQ ID NO: 40281 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggcggatgatcgccccttcttctggctctttgagaatgtggtggccatgggcgttagtgacaagagggacatcgagacgtcggaagagc

SEQ ID NO: 40282 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagcggatcgccccttcttctggctctttgagaatgtggtggccatgggcgttagtgacaagagggacatcgagacgtcggaagagc

SEQ ID NO: 40283 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgcgcgccccttcttctggctctttgagaatgtggtggccatgggcgttagtgacaagagggacatcgagacgtcggaagagc

SEQ ID NO: 40284 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgcgcccttcttctggctctttgagaatgtggtggccatgggcgttagtgacaagagggacatcgagacgtcggaagagc

SEQ ID NO: 40285 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgcgttcttctggctctttgagaatgtggtggccatgggcgttagtgacaagagggacatcgagacgtcggaagagc

SEQ ID NO: 40286 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgcgttctggctctttgagaatgtggtggccatgggcgttagtgacaagagggacatcgagacgtcggaagagc

SEQ ID NO: 40287 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgcgtggctctttgagaatgtggtggccatgggcgttagtgacaagagggacatcgagacgtcggaagagc

SEQ ID NO: 40288 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgcgctctttgagaatgtggtggccatgggcgttagtgacaagagggacatcgagacgtcggaagagc

SEQ ID NO: 40289 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggcgtttgagaatgtggtggccatgggcgttagtgacaagagggacatcgagacgtcggaagagc

SEQ ID NO: 40290 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgcggagaatgtggtggccatgggcgttagtgacaagagggacatcgagacgtcggaagagc

SEQ ID NO: 40291 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgcgaatgtggtggccatgggcgttagtgacaagagggacatcgagacgtcggaagagc

SEQ ID NO: 40292 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggcggtggtggccatgggcgttagtgacaagagggacatcgagacgtcggaagagc

SEQ ID NO: 40293 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgcggtggccatgggcgttagtgacaagagggacatcgagacgtcggaagagc

SEQ ID NO: 40294 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggcggccatgggcgttagtgacaagagggacatcgagacgtcggaagagc

SEQ ID NO: 40295 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcgatgggcgttagtgacaagagggacatcgagacgtcggaagagc

SEQ ID NO: 40296 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgcgggcgttagtgacaagagggacatcgagacgtcggaagagc

SEQ ID NO: 40297 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggcggttagtgacaagagggacatcgagacgtcggaagagc

SEQ ID NO: 40298 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgcgagtgacaagagggacatcgagacgtcggaagagc

SEQ ID NO: 40299 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgcggacaagagggacatcgagacgtcggaagagc

SEQ ID NO: 40300 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgcgaagagggacatcgagacgtcggaagagc

SEQ ID NO: 40301 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgcgagggacatcgagacgtcggaagagc

SEQ ID NO: 40302 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggcggacatcgagacgtcggaagagc

SEQ ID NO: 40303 - RNA, 296 nt, synthetic construct
  source 1..296: mol_type = other RNA
cgctcttccgcgtctcatgtacgccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40304 - RNA, 296 nt, synthetic construct
  source 1..296: mol_type = other RNA
cgctcttccgcgtctcatgtacgtcgccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40305 - RNA, 296 nt, synthetic construct
  source 1..296: mol_type = other RNA
cgctcttccgcgtctcatgtacgtcggggccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40306 - RNA, 296 nt, synthetic construct
  source 1..296: mol_type = other RNA
cgctcttccgcgtctcatgtacgtcggggacgcccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40307 - RNA, 296 nt, synthetic construct
  source 1..296: mol_type = other RNA
cgctcttccgcgtctcatgtacgtcggggacgtcgccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40308 - RNA, 296 nt, synthetic construct
  source 1..296: mol_type = other RNA
cgctcttccgcgtctcatgtacgtcggggacgtccgcgccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40309 - RNA, 296 nt, synthetic construct
  source 1..296: mol_type = other RNA
cgctcttccgcgtctcatgtacgtcggggacgtccgcagcgccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40310 - RNA, 296 nt, synthetic construct
  source 1..296: mol_type = other RNA
cgctcttccgcgtctcatgtacgtcggggacgtccgcagcgtcgcccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40311 - RNA, 296 nt, synthetic construct
  source 1..296: mol_type = other RNA
cgctcttccgcgtctcatgtacgtcggggacgtccgcagcgtcacagccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40312 - RNA, 296 nt, synthetic construct
  source 1..296: mol_type = other RNA
cgctcttccgcgtctcatgtacgtcggggacgtccgcagcgtcacacaggcccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40313 - RNA, 296 nt, synthetic construct
  source 1..296: mol_type = other RNA
cgctcttccgcgtctcatgtacgtcggggacgtccgcagcgtcacacagaaggccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40314 - RNA, 296 nt, synthetic construct
  source 1..296: mol_type = other RNA
cgctcttccgcgtctcatgtacgtcggggacgtccgcagcgtcacacagaagcatgcccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40315 - RNA, 296 nt, synthetic construct
  source 1..296: mol_type = other RNA
cgctcttccgcgtctcatgtacgtcggggacgtccgcagcgtcacacagaagcatatcgccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40316 - RNA, 296 nt, synthetic construct
  source 1..296: mol_type = other RNA
cgctcttccgcgtctcatgtacgtcggggacgtccgcagcgtcacacagaagcatatccaggcctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40317 - RNA, 296 nt, synthetic construct
  source 1..296: mol_type = other RNA
cgctcttccgcgtctcatgtacgtcggggacgtccgcagcgtcacacagaagcatatccaggaggccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40318 - RNA, 296 nt, synthetic construct
  source 1..296: mol_type = other RNA
cgctcttccgcgtctcatgtacgtcggggacgtccgcagcgtcacacagaagcatatccaggagtgggccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40319 - RNA, 296 nt, synthetic construct
  source 1..296: mol_type = other RNA
cgctcttccgcgtctcatgtacgtcggggacgtccgcagcgtcacacagaagcatatccaggagtggggcgccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40320 - RNA, 296 nt, synthetic construct
  source 1..296: mol_type = other RNA
cgctcttccgcgtctcatgtacgtcggggacgtccgcagcgtcacacagaagcatatccaggagtggggcccagccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40321 - RNA, 296 nt, synthetic construct
  source 1..296: mol_type = other RNA
cgctcttccgcgtctcatgtacgtcggggacgtccgcagcgtcacacagaagcatatccaggagtggggcccattcgccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40322 - RNA, 296 nt, synthetic construct
  source 1..296: mol_type = other RNA
cgctcttccgcgtctcatgtacgtcggggacgtccgcagcgtcacacagaagcatatccaggagtggggcccattcgacgccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40323 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40324 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtggccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40325 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattgccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40326 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggagccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40327 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcgccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40328 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtgcctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40329 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccgccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40330 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcgccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40331 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40332 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacgcctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40333 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcgccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40334 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccgccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40335 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40336 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgcccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40337 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40338 - RNA, 296 nt, synthetic construct; identical to SEQ ID NO: 38380
  source 1..296: mol_type = other RNA

SEQ ID NO: 40339 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40340 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40341 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40342 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagcctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40343 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40344 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40345 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40346 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40347 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgcccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40348 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40349 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40350 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgcctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40351 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40352 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40353 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggcctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40354 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgcccgcctcctgcatgatgcgcggcccaaggagggagatgatcgccccttcttctggctctttgagaatgtggtggccatgggcgttagtgacaagagggacatcgagacgtcggaagagc

SEQ ID NO: 40355 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgccctcctgcatgatgcgcggcccaaggagggagatgatcgccccttcttctggctctttgagaatgtggtggccatgggcgttagtgacaagagggacatcgagacgtcggaagagc

SEQ ID NO: 40356 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgccctgcatgatgcgcggcccaaggagggagatgatcgccccttcttctggctctttgagaatgtggtggccatgggcgttagtgacaagagggacatcgagacgtcggaagagc

SEQ ID NO: 40357 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgcccatgatgcgcggcccaaggagggagatgatcgccccttcttctggctctttgagaatgtggtggccatgggcgttagtgacaagagggacatcgagacgtcggaagagc

SEQ ID NO: 40358 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggccgatgcgcggcccaaggagggagatgatcgccccttcttctggctctttgagaatgtggtggccatgggcgttagtgacaagagggacatcgagacgtcggaagagc

SEQ ID NO: 40359 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgccgcgcggcccaaggagggagatgatcgccccttcttctggctctttgagaatgtggtggccatgggcgttagtgacaagagggacatcgagacgtcggaagagc

SEQ ID NO: 40360 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcccggcccaaggagggagatgatcgccccttcttctggctctttgagaatgtggtggccatgggcgttagtgacaagagggacatcgagacgtcggaagagc

SEQ ID NO: 40361 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggcccccaaggagggagatgatcgccccttcttctggctctttgagaatgtggtggccatgggcgttagtgacaagagggacatcgagacgtcggaagagc

SEQ ID NO: 40362 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggccaaggagggagatgatcgccccttcttctggctctttgagaatgtggtggccatgggcgttagtgacaagagggacatcgagacgtcggaagagc

SEQ ID NO: 40363 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgccgagggagatgatcgccccttcttctggctctttgagaatgtggtggccatgggcgttagtgacaagagggacatcgagacgtcggaagagc

SEQ ID NO: 40364 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggccggagatgatcgccccttcttctggctctttgagaatgtggtggccatgggcgttagtgacaagagggacatcgagacgtcggaagagc

SEQ ID NO: 40365 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggccgatgatcgccccttcttctggctctttgagaatgtggtggccatgggcgttagtgacaagagggacatcgagacgtcggaagagc

SEQ ID NO: 40366 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagccgatcgccccttcttctggctctttgagaatgtggtggccatgggcgttagtgacaagagggacatcgagacgtcggaagagc

SEQ ID NO: 40367 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgcccgccccttcttctggctctttgagaatgtggtggccatgggcgttagtgacaagagggacatcgagacgtcggaagagc

SEQ ID NO: 40368 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgcccccttcttctggctctttgagaatgtggtggccatgggcgttagtgacaagagggacatcgagacgtcggaagagc

SEQ ID NO: 40369 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgccttcttctggctctttgagaatgtggtggccatgggcgttagtgacaagagggacatcgagacgtcggaagagc

SEQ ID NO: 40370 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgccttctggctctttgagaatgtggtggccatgggcgttagtgacaagagggacatcgagacgtcggaagagc

SEQ ID NO: 40371 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgcctggctctttgagaatgtggtggccatgggcgttagtgacaagagggacatcgagacgtcggaagagc

SEQ ID NO: 40372 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgccctctttgagaatgtggtggccatgggcgttagtgacaagagggacatcgagacgtcggaagagc

SEQ ID NO: 40373 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggcctttgagaatgtggtggccatgggcgttagtgacaagagggacatcgagacgtcggaagagc

SEQ ID NO: 40374 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgccgagaatgtggtggccatgggcgttagtgacaagagggacatcgagacgtcggaagagc

SEQ ID NO: 40375 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgccaatgtggtggccatgggcgttagtgacaagagggacatcgagacgtcggaagagc

SEQ ID NO: 40376 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggccgtggtggccatgggcgttagtgacaagagggacatcgagacgtcggaagagc

SEQ ID NO: 40377 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgccgtggccatgggcgttagtgacaagagggacatcgagacgtcggaagagc

SEQ ID NO: 40378 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggccgccatgggcgttagtgacaagagggacatcgagacgtcggaagagc

SEQ ID NO: 40379 - RNA, 296 nt, synthetic construct; identical to SEQ ID NO: 38380
  source 1..296: mol_type = other RNA

SEQ ID NO: 40380 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgccggcgttagtgacaagagggacatcgagacgtcggaagagc

SEQ ID NO: 40381 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggccgttagtgacaagagggacatcgagacgtcggaagagc

SEQ ID NO: 40382 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgccagtgacaagagggacatcgagacgtcggaagagc

SEQ ID NO: 40383 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgccgacaagagggacatcgagacgtcggaagagc

SEQ ID NO: 40384 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgccaagagggacatcgagacgtcggaagagc

SEQ ID NO: 40385 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgccagggacatcgagacgtcggaagagc

SEQ ID NO: 40386 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggccgacatcgagacgtcggaagagc

SEQ ID NO: 40387 - RNA, 296 nt, synthetic construct
  source 1..296: mol_type = other RNA
cgctcttccgcgtctcatgtaccagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40388 - RNA, 296 nt, synthetic construct
  source 1..296: mol_type = other RNA
cgctcttccgcgtctcatgtacgtccaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40389 - RNA, 296 nt, synthetic construct
  source 1..296: mol_type = other RNA
cgctcttccgcgtctcatgtacgtcgggcaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40390 - RNA, 296 nt, synthetic construct
  source 1..296: mol_type = other RNA
cgctcttccgcgtctcatgtacgtcggggaccagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40391 - RNA, 296 nt, synthetic construct
  source 1..296: mol_type = other RNA
cgctcttccgcgtctcatgtacgtcggggacgtccagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40392 - RNA, 296 nt, synthetic construct
  source 1..296: mol_type = other RNA
cgctcttccgcgtctcatgtacgtcggggacgtccgccaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40393 - RNA, 296 nt, synthetic construct
  source 1..296: mol_type = other RNA
cgctcttccgcgtctcatgtacgtcggggacgtccgcagccagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40394 - RNA, 296 nt, synthetic construct
  source 1..296: mol_type = other RNA
cgctcttccgcgtctcatgtacgtcggggacgtccgcagcgtccagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40395 - RNA, 296 nt, synthetic construct; identical to SEQ ID NO: 38380
  source 1..296: mol_type = other RNA

SEQ ID NO: 40396 - RNA, 296 nt, synthetic construct
  source 1..296: mol_type = other RNA
cgctcttccgcgtctcatgtacgtcggggacgtccgcagcgtcacacagcagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40397 - RNA, 296 nt, synthetic construct
  source 1..296: mol_type = other RNA
cgctcttccgcgtctcatgtacgtcggggacgtccgcagcgtcacacagaagcagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40398 - RNA, 296 nt, synthetic construct
  source 1..296: mol_type = other RNA
cgctcttccgcgtctcatgtacgtcggggacgtccgcagcgtcacacagaagcatcagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40399 - RNA, 296 nt, synthetic construct; identical to SEQ ID NO: 38380
  source 1..296: mol_type = other RNA

SEQ ID NO: 40400 - RNA, 296 nt, synthetic construct
  source 1..296: mol_type = other RNA
cgctcttccgcgtctcatgtacgtcggggacgtccgcagcgtcacacagaagcatatccagcagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40401 - RNA, 296 nt, synthetic construct
  source 1..296: mol_type = other RNA
cgctcttccgcgtctcatgtacgtcggggacgtccgcagcgtcacacagaagcatatccaggagcagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40402 - RNA, 296 nt, synthetic construct
  source 1..296: mol_type = other RNA
cgctcttccgcgtctcatgtacgtcggggacgtccgcagcgtcacacagaagcatatccaggagtggcagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40403 - RNA, 296 nt, synthetic construct
  source 1..296: mol_type = other RNA
cgctcttccgcgtctcatgtacgtcggggacgtccgcagcgtcacacagaagcatatccaggagtggggccagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40404 - RNA, 296 nt, synthetic construct
  source 1..296: mol_type = other RNA
cgctcttccgcgtctcatgtacgtcggggacgtccgcagcgtcacacagaagcatatccaggagtggggcccacaggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40405 - RNA, 296 nt, synthetic construct
  source 1..296: mol_type = other RNA
cgctcttccgcgtctcatgtacgtcggggacgtccgcagcgtcacacagaagcatatccaggagtggggcccattccagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40406 - RNA, 296 nt, synthetic construct
  source 1..296: mol_type = other RNA
cgctcttccgcgtctcatgtacgtcggggacgtccgcagcgtcacacagaagcatatccaggagtggggcccattcgaccaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40407 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgcagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40408 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgcagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40409 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattcagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40410 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggacagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40411 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggccagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40412 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40413 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccccagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40414 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgccaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40415 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaaccagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40416 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgaccagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40417 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctccagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40418 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcccaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40419 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattcagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40420 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40421 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40422 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40423 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40424 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40425 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40426 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40427 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40428 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40429 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40430 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40431 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40432 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40433 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40434 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40435 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40436 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40437 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40438 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccagcgcctcctgcatgatgcgcggcccaaggagggagatgatcgccccttcttctggctctttgagaatgtggtggccatgggcgttagtgacaagagggacatcgagacgtcggaagagc

SEQ ID NO: 40439 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccagctcctgcatgatgcgcggcccaaggagggagatgatcgccccttcttctggctctttgagaatgtggtggccatgggcgttagtgacaagagggacatcgagacgtcggaagagc

SEQ ID NO: 40440 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccagctgcatgatgcgcggcccaaggagggagatgatcgccccttcttctggctctttgagaatgtggtggccatgggcgttagtgacaagagggacatcgagacgtcggaagagc

SEQ ID NO: 40441 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccagcatgatgcgcggcccaaggagggagatgatcgccccttcttctggctctttgagaatgtggtggccatgggcgttagtgacaagagggacatcgagacgtcggaagagc

SEQ ID NO: 40442 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcaggatgcgcggcccaaggagggagatgatcgccccttcttctggctctttgagaatgtggtggccatgggcgttagtgacaagagggacatcgagacgtcggaagagc

SEQ ID NO: 40443 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcaggcgcggcccaaggagggagatgatcgccccttcttctggctctttgagaatgtggtggccatgggcgttagtgacaagagggacatcgagacgtcggaagagc

SEQ ID NO: 40444 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcagcggcccaaggagggagatgatcgccccttcttctggctctttgagaatgtggtggccatgggcgttagtgacaagagggacatcgagacgtcggaagagc

SEQ ID NO: 40445 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcagcccaaggagggagatgatcgccccttcttctggctctttgagaatgtggtggccatgggcgttagtgacaagagggacatcgagacgtcggaagagc

SEQ ID NO: 40446 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcagaaggagggagatgatcgccccttcttctggctctttgagaatgtggtggccatgggcgttagtgacaagagggacatcgagacgtcggaagagc

SEQ ID NO: 40447 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccaggagggagatgatcgccccttcttctggctctttgagaatgtggtggccatgggcgttagtgacaagagggacatcgagacgtcggaagagc

SEQ ID NO: 40448 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcagggagatgatcgccccttcttctggctctttgagaatgtggtggccatgggcgttagtgacaagagggacatcgagacgtcggaagagc

SEQ ID NO: 40449 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcaggatgatcgccccttcttctggctctttgagaatgtggtggccatgggcgttagtgacaagagggacatcgagacgtcggaagagc

SEQ ID NO: 40450 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacaggatcgccccttcttctggctctttgagaatgtggtggccatgggcgttagtgacaagagggacatcgagacgtcggaagagc

SEQ ID NO: 40451 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcagcgccccttcttctggctctttgagaatgtggtggccatgggcgttagtgacaagagggacatcgagacgtcggaagagc

SEQ ID NO: 40452 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcagcccttcttctggctctttgagaatgtggtggccatgggcgttagtgacaagagggacatcgagacgtcggaagagc

SEQ ID NO: 40453 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccagttcttctggctctttgagaatgtggtggccatgggcgttagtgacaagagggacatcgagacgtcggaagagc

SEQ ID NO: 40454 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccagttctggctctttgagaatgtggtggccatgggcgttagtgacaagagggacatcgagacgtcggaagagc

SEQ ID NO: 40455 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccagtggctctttgagaatgtggtggccatgggcgttagtgacaagagggacatcgagacgtcggaagagc

SEQ ID NO: 40456 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccagctctttgagaatgtggtggccatgggcgttagtgacaagagggacatcgagacgtcggaagagc

SEQ ID NO: 40457 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcagtttgagaatgtggtggccatgggcgttagtgacaagagggacatcgagacgtcggaagagc

SEQ ID NO: 40458 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccaggagaatgtggtggccatgggcgttagtgacaagagggacatcgagacgtcggaagagc

SEQ ID NO: 40459 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcagaatgtggtggccatgggcgttagtgacaagagggacatcgagacgtcggaagagc

SEQ ID NO: 40460 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcaggtggtggccatgggcgttagtgacaagagggacatcgagacgtcggaagagc

SEQ ID NO: 40461 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcaggtggccatgggcgttagtgacaagagggacatcgagacgtcggaagagc

SEQ ID NO: 40462 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcaggccatgggcgttagtgacaagagggacatcgagacgtcggaagagc

SEQ ID NO: 40463 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcagatgggcgttagtgacaagagggacatcgagacgtcggaagagc

SEQ ID NO: 40464 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccagggcgttagtgacaagagggacatcgagacgtcggaagagc

SEQ ID NO: 40465 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcaggttagtgacaagagggacatcgagacgtcggaagagc

SEQ ID NO: 40466 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccagagtgacaagagggacatcgagacgtcggaagagc

SEQ ID NO: 40467 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcaggacaagagggacatcgagacgtcggaagagc

SEQ ID NO: 40468 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcagaagagggacatcgagacgtcggaagagc

SEQ ID NO: 40469 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccagagggacatcgagacgtcggaagagc

SEQ ID NO: 40470 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcaggacatcgagacgtcggaagagc

SEQ ID NO: 40471 - RNA, 296 nt, synthetic construct
  source 1..296: mol_type = other RNA
cgctcttccgcgtctcatgtaccacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40472 - RNA, 296 nt, synthetic construct
  source 1..296: mol_type = other RNA
cgctcttccgcgtctcatgtacgtccacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40473 - RNA, 296 nt, synthetic construct
  source 1..296: mol_type = other RNA
cgctcttccgcgtctcatgtacgtcgggcacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40474 - RNA, 296 nt, synthetic construct
  source 1..296: mol_type = other RNA
cgctcttccgcgtctcatgtacgtcggggaccaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40475 - RNA, 296 nt, synthetic construct
  source 1..296: mol_type = other RNA
cgctcttccgcgtctcatgtacgtcggggacgtccacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40476 - RNA, 296 nt, synthetic construct
  source 1..296: mol_type = other RNA
cgctcttccgcgtctcatgtacgtcggggacgtccgccacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40477 - RNA, 296 nt, synthetic construct
  source 1..296: mol_type = other RNA
cgctcttccgcgtctcatgtacgtcggggacgtccgcagccacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40478 - RNA, 296 nt, synthetic construct
  source 1..296: mol_type = other RNA
cgctcttccgcgtctcatgtacgtcggggacgtccgcagcgtccaccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40479 - RNA, 296 nt, synthetic construct
  source 1..296: mol_type = other RNA
cgctcttccgcgtctcatgtacgtcggggacgtccgcagcgtcacacacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40480 - RNA, 296 nt, synthetic construct
  source 1..296: mol_type = other RNA
cgctcttccgcgtctcatgtacgtcggggacgtccgcagcgtcacacagcaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40481 - RNA, 296 nt, synthetic construct
  source 1..296: mol_type = other RNA
cgctcttccgcgtctcatgtacgtcggggacgtccgcagcgtcacacagaagcacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40482 - RNA, 296 nt, synthetic construct
  source 1..296: mol_type = other RNA
cgctcttccgcgtctcatgtacgtcggggacgtccgcagcgtcacacagaagcatcaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40483 - RNA, 296 nt, synthetic construct
  source 1..296: mol_type = other RNA
cgctcttccgcgtctcatgtacgtcggggacgtccgcagcgtcacacagaagcatatccacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40484 - RNA, 296 nt, synthetic construct
  source 1..296: mol_type = other RNA
cgctcttccgcgtctcatgtacgtcggggacgtccgcagcgtcacacagaagcatatccagcactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40485 - RNA, 296 nt, synthetic construct
  source 1..296: mol_type = other RNA
cgctcttccgcgtctcatgtacgtcggggacgtccgcagcgtcacacagaagcatatccaggagcacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40486 - RNA, 296 nt, synthetic construct
  source 1..296: mol_type = other RNA
cgctcttccgcgtctcatgtacgtcggggacgtccgcagcgtcacacagaagcatatccaggagtggcacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40487 - RNA, 296 nt, synthetic construct
  source 1..296: mol_type = other RNA
cgctcttccgcgtctcatgtacgtcggggacgtccgcagcgtcacacagaagcatatccaggagtggggccacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40488 - RNA, 296 nt, synthetic construct
  source 1..296: mol_type = other RNA
cgctcttccgcgtctcatgtacgtcggggacgtccgcagcgtcacacagaagcatatccaggagtggggcccacacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40489 - RNA, 296 nt, synthetic construct
  source 1..296: mol_type = other RNA
cgctcttccgcgtctcatgtacgtcggggacgtccgcagcgtcacacagaagcatatccaggagtggggcccattccacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40490 - RNA, 296 nt, synthetic construct
  source 1..296: mol_type = other RNA
cgctcttccgcgtctcatgtacgtcggggacgtccgcagcgtcacacagaagcatatccaggagtggggcccattcgaccacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40491 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgcacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40492 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgcacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40493 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattcacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40494 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggacacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40495 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggccacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40496 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40497 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccccacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40498 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgccacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40499 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaaccacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40500 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgaccactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40501 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctccacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40502 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcccacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40503 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattcacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40504 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40505 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40506 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40507 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40508 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40509 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40510 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40511 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40512 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40513 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40514 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40515 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40516 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40517 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40518 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40519 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40520 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40521 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40522 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40523 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccacctcctgcatgatgcgcggcccaaggagggagatgatcgccccttcttctggctctttgagaatgtggtggccatgggcgttagtgacaagagggacatcgagacgtcggaagagc

SEQ ID NO: 40524 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccacctgcatgatgcgcggcccaaggagggagatgatcgccccttcttctggctctttgagaatgtggtggccatgggcgttagtgacaagagggacatcgagacgtcggaagagc

SEQ ID NO: 40525 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccaccatgatgcgcggcccaaggagggagatgatcgccccttcttctggctctttgagaatgtggtggccatgggcgttagtgacaagagggacatcgagacgtcggaagagc

SEQ ID NO: 40526 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcacgatgcgcggcccaaggagggagatgatcgccccttcttctggctctttgagaatgtggtggccatgggcgttagtgacaagagggacatcgagacgtcggaagagc

SEQ ID NO: 40527 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcacgcgcggcccaaggagggagatgatcgccccttcttctggctctttgagaatgtggtggccatgggcgttagtgacaagagggacatcgagacgtcggaagagc

SEQ ID NO: 40528 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcaccggcccaaggagggagatgatcgccccttcttctggctctttgagaatgtggtggccatgggcgttagtgacaagagggacatcgagacgtcggaagagc

SEQ ID NO: 40529 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcaccccaaggagggagatgatcgccccttcttctggctctttgagaatgtggtggccatgggcgttagtgacaagagggacatcgagacgtcggaagagc

SEQ ID NO: 40530 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcacaaggagggagatgatcgccccttcttctggctctttgagaatgtggtggccatgggcgttagtgacaagagggacatcgagacgtcggaagagc

SEQ ID NO: 40531 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccacgagggagatgatcgccccttcttctggctctttgagaatgtggtggccatgggcgttagtgacaagagggacatcgagacgtcggaagagc

SEQ ID NO: 40532 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcacggagatgatcgccccttcttctggctctttgagaatgtggtggccatgggcgttagtgacaagagggacatcgagacgtcggaagagc

SEQ ID NO: 40533 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcacgatgatcgccccttcttctggctctttgagaatgtggtggccatgggcgttagtgacaagagggacatcgagacgtcggaagagc

SEQ ID NO: 40534 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacacgatcgccccttcttctggctctttgagaatgtggtggccatgggcgttagtgacaagagggacatcgagacgtcggaagagc

SEQ ID NO: 40535 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcaccgccccttcttctggctctttgagaatgtggtggccatgggcgttagtgacaagagggacatcgagacgtcggaagagc

SEQ ID NO: 40536 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcaccccttcttctggctctttgagaatgtggtggccatgggcgttagtgacaagagggacatcgagacgtcggaagagc

SEQ ID NO: 40537 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccacttcttctggctctttgagaatgtggtggccatgggcgttagtgacaagagggacatcgagacgtcggaagagc

SEQ ID NO: 40538 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccacttctggctctttgagaatgtggtggccatgggcgttagtgacaagagggacatcgagacgtcggaagagc

SEQ ID NO: 40539 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccactggctctttgagaatgtggtggccatgggcgttagtgacaagagggacatcgagacgtcggaagagc

SEQ ID NO: 40540 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccacctctttgagaatgtggtggccatgggcgttagtgacaagagggacatcgagacgtcggaagagc

SEQ ID NO: 40541 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcactttgagaatgtggtggccatgggcgttagtgacaagagggacatcgagacgtcggaagagc

SEQ ID NO: 40542 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccacgagaatgtggtggccatgggcgttagtgacaagagggacatcgagacgtcggaagagc

SEQ ID NO: 40543 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcacaatgtggtggccatgggcgttagtgacaagagggacatcgagacgtcggaagagc

SEQ ID NO: 40544 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcacgtggtggccatgggcgttagtgacaagagggacatcgagacgtcggaagagc

SEQ ID NO: 40545 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcacgtggccatgggcgttagtgacaagagggacatcgagacgtcggaagagc

SEQ ID NO: 40546 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcacgccatgggcgttagtgacaagagggacatcgagacgtcggaagagc

SEQ ID NO: 40547 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcacatgggcgttagtgacaagagggacatcgagacgtcggaagagc

SEQ ID NO: 40548 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccacggcgttagtgacaagagggacatcgagacgtcggaagagc

SEQ ID NO: 40549 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcacgttagtgacaagagggacatcgagacgtcggaagagc

SEQ ID NO: 40550 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccacagtgacaagagggacatcgagacgtcggaagagc

SEQ ID NO: 40551 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcacgacaagagggacatcgagacgtcggaagagc

SEQ ID NO: 40552 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcacaagagggacatcgagacgtcggaagagc

SEQ ID NO: 40553 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccacagggacatcgagacgtcggaagagc

SEQ ID NO: 40554 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcacgacatcgagacgtcggaagagc

SEQ ID NO: 40555 - RNA, 296 nt, synthetic construct
  source 1..296: mol_type = other RNA
cgctcttccgcgtctcatgtacctgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40556 - RNA, 296 nt, synthetic construct
  source 1..296: mol_type = other RNA
cgctcttccgcgtctcatgtacgtcctggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40557 - RNA, 296 nt, synthetic construct
  source 1..296: mol_type = other RNA
cgctcttccgcgtctcatgtacgtcgggctggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40558 - RNA, 296 nt, synthetic construct
  source 1..296: mol_type = other RNA
cgctcttccgcgtctcatgtacgtcggggacctgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40559 - RNA, 296 nt, synthetic construct
  source 1..296: mol_type = other RNA
cgctcttccgcgtctcatgtacgtcggggacgtcctgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40560 - RNA, 296 nt, synthetic construct
  source 1..296: mol_type = other RNA
cgctcttccgcgtctcatgtacgtcggggacgtccgcctggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40561 - RNA, 296 nt, synthetic construct
  source 1..296: mol_type = other RNA
cgctcttccgcgtctcatgtacgtcggggacgtccgcagcctgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40562 - RNA, 296 nt, synthetic construct
  source 1..296: mol_type = other RNA
cgctcttccgcgtctcatgtacgtcggggacgtccgcagcgtcctgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40563 - RNA, 296 nt, synthetic construct
  source 1..296: mol_type = other RNA
cgctcttccgcgtctcatgtacgtcggggacgtccgcagcgtcacactgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40564 - RNA, 296 nt, synthetic construct
  source 1..296: mol_type = other RNA
cgctcttccgcgtctcatgtacgtcggggacgtccgcagcgtcacacagctgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40565 - RNA, 296 nt, synthetic construct
  source 1..296: mol_type = other RNA
cgctcttccgcgtctcatgtacgtcggggacgtccgcagcgtcacacagaagctgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40566 - RNA, 296 nt, synthetic construct
  source 1..296: mol_type = other RNA
cgctcttccgcgtctcatgtacgtcggggacgtccgcagcgtcacacagaagcatctgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40567 - RNA, 296 nt, synthetic construct
  source 1..296: mol_type = other RNA
cgctcttccgcgtctcatgtacgtcggggacgtccgcagcgtcacacagaagcatatcctggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40568 - RNA, 296 nt, synthetic construct
  source 1..296: mol_type = other RNA
cgctcttccgcgtctcatgtacgtcggggacgtccgcagcgtcacacagaagcatatccagctgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40569 - RNA, 296 nt, synthetic construct
  source 1..296: mol_type = other RNA
cgctcttccgcgtctcatgtacgtcggggacgtccgcagcgtcacacagaagcatatccaggagctgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40570 - RNA, 296 nt, synthetic construct
  source 1..296: mol_type = other RNA
cgctcttccgcgtctcatgtacgtcggggacgtccgcagcgtcacacagaagcatatccaggagtggctgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40571 - RNA, 296 nt, synthetic construct
  source 1..296: mol_type = other RNA
cgctcttccgcgtctcatgtacgtcggggacgtccgcagcgtcacacagaagcatatccaggagtggggcctgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40572 - RNA, 296 nt, synthetic construct
  source 1..296: mol_type = other RNA
cgctcttccgcgtctcatgtacgtcggggacgtccgcagcgtcacacagaagcatatccaggagtggggcccactggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40573 - RNA, 296 nt, synthetic construct
  source 1..296: mol_type = other RNA
cgctcttccgcgtctcatgtacgtcggggacgtccgcagcgtcacacagaagcatatccaggagtggggcccattcctgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40574 - RNA, 296 nt, synthetic construct; identical to SEQ ID NO: 38380
  source 1..296: mol_type = other RNA

SEQ ID NO: 40575 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgctgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40576 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgctgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40577 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattctgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40578 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggactgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40579 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcctgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40580 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtctgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40581 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccctgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40582 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcctggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40583 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacctgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40584 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40585 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcctgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40586 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccctggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40587 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattctgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40588 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcctgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40589 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacctggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40590 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctctgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40591 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccctgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40592 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcctgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40593 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagctgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40594 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40595 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttctggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40596 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatctgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40597 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagctgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40598 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtctgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40599 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactctgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40600 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcctgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40601 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40602 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcctgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40603 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcctggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40604 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttctgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40605 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagctgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40606 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcctgcgcctcctgcatgatgcgcggcccaaggagggagatgatcgccccttcttctggctctttgagaatgtggtggccatgggcgttagtgacaagagggacatcgagacgtcggaagagc

SEQ ID NO: 40607 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacctgctcctgcatgatgcgcggcccaaggagggagatgatcgccccttcttctggctctttgagaatgtggtggccatgggcgttagtgacaagagggacatcgagacgtcggaagagc

SEQ ID NO: 40608 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctgctgcatgatgcgcggcccaaggagggagatgatcgccccttcttctggctctttgagaatgtggtggccatgggcgttagtgacaagagggacatcgagacgtcggaagagc

SEQ ID NO: 40609 - RNA, 296 nt, synthetic construct; identical to SEQ ID NO: 38380
  source 1..296: mol_type = other RNA

SEQ ID NO: 40610 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgctggatgcgcggcccaaggagggagatgatcgccccttcttctggctctttgagaatgtggtggccatgggcgttagtgacaagagggacatcgagacgtcggaagagc

SEQ ID NO: 40611 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatctggcgcggcccaaggagggagatgatcgccccttcttctggctctttgagaatgtggtggccatgggcgttagtgacaagagggacatcgagacgtcggaagagc

SEQ ID NO: 40612 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatctgcggcccaaggagggagatgatcgccccttcttctggctctttgagaatgtggtggccatgggcgttagtgacaagagggacatcgagacgtcggaagagc

SEQ ID NO: 40613 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgctgcccaaggagggagatgatcgccccttcttctggctctttgagaatgtggtggccatgggcgttagtgacaagagggacatcgagacgtcggaagagc

SEQ ID NO: 40614 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggctgaaggagggagatgatcgccccttcttctggctctttgagaatgtggtggccatgggcgttagtgacaagagggacatcgagacgtcggaagagc

SEQ ID NO: 40615 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccctggagggagatgatcgccccttcttctggctctttgagaatgtggtggccatgggcgttagtgacaagagggacatcgagacgtcggaagagc

SEQ ID NO: 40616 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagctgggagatgatcgccccttcttctggctctttgagaatgtggtggccatgggcgttagtgacaagagggacatcgagacgtcggaagagc

SEQ ID NO: 40617 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagctggatgatcgccccttcttctggctctttgagaatgtggtggccatgggcgttagtgacaagagggacatcgagacgtcggaagagc

SEQ ID NO: 40618 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggactggatcgccccttcttctggctctttgagaatgtggtggccatgggcgttagtgacaagagggacatcgagacgtcggaagagc

SEQ ID NO: 40619 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatctgcgccccttcttctggctctttgagaatgtggtggccatgggcgttagtgacaagagggacatcgagacgtcggaagagc

SEQ ID NO: 40620 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatctgcccttcttctggctctttgagaatgtggtggccatgggcgttagtgacaagagggacatcgagacgtcggaagagc

SEQ ID NO: 40621 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcctgttcttctggctctttgagaatgtggtggccatgggcgttagtgacaagagggacatcgagacgtcggaagagc

SEQ ID NO: 40622 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccctgttctggctctttgagaatgtggtggccatgggcgttagtgacaagagggacatcgagacgtcggaagagc

SEQ ID NO: 40623 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcctgtggctctttgagaatgtggtggccatgggcgttagtgacaagagggacatcgagacgtcggaagagc

SEQ ID NO: 40624 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcctgctctttgagaatgtggtggccatgggcgttagtgacaagagggacatcgagacgtcggaagagc

SEQ ID NO: 40625 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctgtttgagaatgtggtggccatgggcgttagtgacaagagggacatcgagacgtcggaagagc

SEQ ID NO: 40626 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcctggagaatgtggtggccatgggcgttagtgacaagagggacatcgagacgtcggaagagc

SEQ ID NO: 40627 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttctgaatgtggtggccatgggcgttagtgacaagagggacatcgagacgtcggaagagc

SEQ ID NO: 40628 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagctggtggtggccatgggcgttagtgacaagagggacatcgagacgtcggaagagc

SEQ ID NO: 40629 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatctggtggccatgggcgttagtgacaagagggacatcgagacgtcggaagagc

SEQ ID NO: 40630 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgctggccatgggcgttagtgacaagagggacatcgagacgtcggaagagc

SEQ ID NO: 40631 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgctgatgggcgttagtgacaagagggacatcgagacgtcggaagagc

SEQ ID NO: 40632 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccctgggcgttagtgacaagagggacatcgagacgtcggaagagc

SEQ ID NO: 40633 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgctggttagtgacaagagggacatcgagacgtcggaagagc

SEQ ID NO: 40634 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcctgagtgacaagagggacatcgagacgtcggaagagc

SEQ ID NO: 40635 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttctggacaagagggacatcgagacgtcggaagagc

SEQ ID NO: 40636 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtctgaagagggacatcgagacgtcggaagagc

SEQ ID NO: 40637 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacctgagggacatcgagacgtcggaagagc

SEQ ID NO: 40638 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagctggacatcgagacgtcggaagagc

SEQ ID NO: 40639 - RNA, 296 nt, synthetic construct
  source 1..296: mol_type = other RNA
cgctcttccgcgtctcatgtacctcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40640 - RNA, 296 nt, synthetic construct
  source 1..296: mol_type = other RNA
cgctcttccgcgtctcatgtacgtcctcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40641 - RNA, 296 nt, synthetic construct
  source 1..296: mol_type = other RNA
cgctcttccgcgtctcatgtacgtcgggctcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40642 - RNA, 296 nt, synthetic construct
  source 1..296: mol_type = other RNA
cgctcttccgcgtctcatgtacgtcggggacctccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40643 - RNA, 296 nt, synthetic construct
  source 1..296: mol_type = other RNA
cgctcttccgcgtctcatgtacgtcggggacgtcctcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40644 - RNA, 296 nt, synthetic construct
  source 1..296: mol_type = other RNA
cgctcttccgcgtctcatgtacgtcggggacgtccgcctcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40645 - RNA, 296 nt, synthetic construct
  source 1..296: mol_type = other RNA
cgctcttccgcgtctcatgtacgtcggggacgtccgcagcctcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40646 - RNA, 296 nt, synthetic construct
  source 1..296: mol_type = other RNA
cgctcttccgcgtctcatgtacgtcggggacgtccgcagcgtcctccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40647 - RNA, 296 nt, synthetic construct
  source 1..296: mol_type = other RNA
cgctcttccgcgtctcatgtacgtcggggacgtccgcagcgtcacactcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40648 - RNA, 296 nt, synthetic construct
  source 1..296: mol_type = other RNA
cgctcttccgcgtctcatgtacgtcggggacgtccgcagcgtcacacagctccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40649 - RNA, 296 nt, synthetic construct
  source 1..296: mol_type = other RNA
cgctcttccgcgtctcatgtacgtcggggacgtccgcagcgtcacacagaagctcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40650 - RNA, 296 nt, synthetic construct
  source 1..296: mol_type = other RNA
cgctcttccgcgtctcatgtacgtcggggacgtccgcagcgtcacacagaagcatctccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40651 - RNA, 296 nt, synthetic construct
  source 1..296: mol_type = other RNA
cgctcttccgcgtctcatgtacgtcggggacgtccgcagcgtcacacagaagcatatcctcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40652 - RNA, 296 nt, synthetic construct
  source 1..296: mol_type = other RNA
cgctcttccgcgtctcatgtacgtcggggacgtccgcagcgtcacacagaagcatatccagctctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40653 - RNA, 296 nt, synthetic construct
  source 1..296: mol_type = other RNA
cgctcttccgcgtctcatgtacgtcggggacgtccgcagcgtcacacagaagcatatccaggagctcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40654 - RNA, 296 nt, synthetic construct
  source 1..296: mol_type = other RNA
cgctcttccgcgtctcatgtacgtcggggacgtccgcagcgtcacacagaagcatatccaggagtggctcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40655 - RNA, 296 nt, synthetic construct
  source 1..296: mol_type = other RNA
cgctcttccgcgtctcatgtacgtcggggacgtccgcagcgtcacacagaagcatatccaggagtggggcctcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40656 - RNA, 296 nt, synthetic construct
  source 1..296: mol_type = other RNA
cgctcttccgcgtctcatgtacgtcggggacgtccgcagcgtcacacagaagcatatccaggagtggggcccactcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40657 - RNA, 296 nt, synthetic construct
  source 1..296: mol_type = other RNA
cgctcttccgcgtctcatgtacgtcggggacgtccgcagcgtcacacagaagcatatccaggagtggggcccattcctcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40658 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40659 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgctcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40660 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgctcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40661 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattctcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40662 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggactcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40663 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcctcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40664 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtctctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40665 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccctcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40666 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcctcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40667 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacctcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40668 - RNA, 296 nt, synthetic construct; identical to SEQ ID NO: 38380
  source 1..296: mol_type = other RNA

SEQ ID NO: 40669 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcctcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40670 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccctcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40671 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattctcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40672 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcctccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40673 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacctcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40674 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctctccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40675 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccctcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40676 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcctcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40677 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagctcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40678 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40679 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttctcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40680 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatctcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40681 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagctcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40682 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtctcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40683 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactctccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40684 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcctcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40685 - RNA, 296 nt, synthetic construct; identical to SEQ ID NO: 38380
  source 1..296: mol_type = other RNA

SEQ ID NO: 40686 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcctctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40687 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcctcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40688 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttctcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40689 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagctctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40690 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcctccgcctcctgcatgatgcgcggcccaaggagggagatgatcgccccttcttctggctctttgagaatgtggtggccatgggcgttagtgacaagagggacatcgagacgtcggaagagc

SEQ ID NO: 40691 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacctcctcctgcatgatgcgcggcccaaggagggagatgatcgccccttcttctggctctttgagaatgtggtggccatgggcgttagtgacaagagggacatcgagacgtcggaagagc

SEQ ID NO: 40692 - RNA, 296 nt, synthetic construct; identical to SEQ ID NO: 38380
  source 1..296: mol_type = other RNA

SEQ ID NO: 40693 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctccatgatgcgcggcccaaggagggagatgatcgccccttcttctggctctttgagaatgtggtggccatgggcgttagtgacaagagggacatcgagacgtcggaagagc

SEQ ID NO: 40694 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgctcgatgcgcggcccaaggagggagatgatcgccccttcttctggctctttgagaatgtggtggccatgggcgttagtgacaagagggacatcgagacgtcggaagagc

SEQ ID NO: 40695 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatctcgcgcggcccaaggagggagatgatcgccccttcttctggctctttgagaatgtggtggccatgggcgttagtgacaagagggacatcgagacgtcggaagagc

SEQ ID NO: 40696 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatctccggcccaaggagggagatgatcgccccttcttctggctctttgagaatgtggtggccatgggcgttagtgacaagagggacatcgagacgtcggaagagc

SEQ ID NO: 40697 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgctccccaaggagggagatgatcgccccttcttctggctctttgagaatgtggtggccatgggcgttagtgacaagagggacatcgagacgtcggaagagc

SEQ ID NO: 40698 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggctcaaggagggagatgatcgccccttcttctggctctttgagaatgtggtggccatgggcgttagtgacaagagggacatcgagacgtcggaagagc

SEQ ID NO: 40699 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccctcgagggagatgatcgccccttcttctggctctttgagaatgtggtggccatgggcgttagtgacaagagggacatcgagacgtcggaagagc

SEQ ID NO: 40700 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagctcggagatgatcgccccttcttctggctctttgagaatgtggtggccatgggcgttagtgacaagagggacatcgagacgtcggaagagc

SEQ ID NO: 40701 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagctcgatgatcgccccttcttctggctctttgagaatgtggtggccatgggcgttagtgacaagagggacatcgagacgtcggaagagc

SEQ ID NO: 40702 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggactcgatcgccccttcttctggctctttgagaatgtggtggccatgggcgttagtgacaagagggacatcgagacgtcggaagagc

SEQ ID NO: 40703 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatctccgccccttcttctggctctttgagaatgtggtggccatgggcgttagtgacaagagggacatcgagacgtcggaagagc

SEQ ID NO: 40704 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatctccccttcttctggctctttgagaatgtggtggccatgggcgttagtgacaagagggacatcgagacgtcggaagagc

SEQ ID NO: 40705 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcctcttcttctggctctttgagaatgtggtggccatgggcgttagtgacaagagggacatcgagacgtcggaagagc

SEQ ID NO: 40706 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccctcttctggctctttgagaatgtggtggccatgggcgttagtgacaagagggacatcgagacgtcggaagagc

SEQ ID NO: 40707 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcctctggctctttgagaatgtggtggccatgggcgttagtgacaagagggacatcgagacgtcggaagagc

SEQ ID NO: 40708 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcctcctctttgagaatgtggtggccatgggcgttagtgacaagagggacatcgagacgtcggaagagc

SEQ ID NO: 40709 - RNA, 296 nt, synthetic construct; identical to SEQ ID NO: 38380
  source 1..296: mol_type = other RNA

SEQ ID NO: 40710 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcctcgagaatgtggtggccatgggcgttagtgacaagagggacatcgagacgtcggaagagc

SEQ ID NO: 40711 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttctcaatgtggtggccatgggcgttagtgacaagagggacatcgagacgtcggaagagc

SEQ ID NO: 40712 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagctcgtggtggccatgggcgttagtgacaagagggacatcgagacgtcggaagagc

SEQ ID NO: 40713 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatctcgtggccatgggcgttagtgacaagagggacatcgagacgtcggaagagc

SEQ ID NO: 40714 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgctcgccatgggcgttagtgacaagagggacatcgagacgtcggaagagc

SEQ ID NO: 40715 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgctcatgggcgttagtgacaagagggacatcgagacgtcggaagagc

SEQ ID NO: 40716 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccctcggcgttagtgacaagagggacatcgagacgtcggaagagc

SEQ ID NO: 40717 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgctcgttagtgacaagagggacatcgagacgtcggaagagc

SEQ ID NO: 40718 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcctcagtgacaagagggacatcgagacgtcggaagagc

SEQ ID NO: 40719 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttctcgacaagagggacatcgagacgtcggaagagc

SEQ ID NO: 40720 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtctcaagagggacatcgagacgtcggaagagc

SEQ ID NO: 40721 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacctcagggacatcgagacgtcggaagagc

SEQ ID NO: 40722 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagctcgacatcgagacgtcggaagagc

SEQ ID NO: 40723 - RNA, 296 nt, synthetic construct
  source 1..296: mol_type = other RNA
cgctcttccgcgtctcatgtaccggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40724 - RNA, 296 nt, synthetic construct
  source 1..296: mol_type = other RNA
cgctcttccgcgtctcatgtacgtccgggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40725 - RNA, 296 nt, synthetic construct
  source 1..296: mol_type = other RNA
cgctcttccgcgtctcatgtacgtcgggcgggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40726 - RNA, 296 nt, synthetic construct
  source 1..296: mol_type = other RNA
cgctcttccgcgtctcatgtacgtcggggaccggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40727 - RNA, 296 nt, synthetic construct
  source 1..296: mol_type = other RNA
cgctcttccgcgtctcatgtacgtcggggacgtccggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40728 - RNA, 296 nt, synthetic construct
  source 1..296: mol_type = other RNA
cgctcttccgcgtctcatgtacgtcggggacgtccgccgggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40729 - RNA, 296 nt, synthetic construct
  source 1..296: mol_type = other RNA
cgctcttccgcgtctcatgtacgtcggggacgtccgcagccggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40730 - RNA, 296 nt, synthetic construct
  source 1..296: mol_type = other RNA
cgctcttccgcgtctcatgtacgtcggggacgtccgcagcgtccggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40731 - RNA, 296 nt, synthetic construct
  source 1..296: mol_type = other RNA
cgctcttccgcgtctcatgtacgtcggggacgtccgcagcgtcacacggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40732 - RNA, 296 nt, synthetic construct
  source 1..296: mol_type = other RNA
cgctcttccgcgtctcatgtacgtcggggacgtccgcagcgtcacacagcggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40733 - RNA, 296 nt, synthetic construct
  source 1..296: mol_type = other RNA
cgctcttccgcgtctcatgtacgtcggggacgtccgcagcgtcacacagaagcggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40734 - RNA, 296 nt, synthetic construct
  source 1..296: mol_type = other RNA
cgctcttccgcgtctcatgtacgtcggggacgtccgcagcgtcacacagaagcatcggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40735 - RNA, 296 nt, synthetic construct
  source 1..296: mol_type = other RNA
cgctcttccgcgtctcatgtacgtcggggacgtccgcagcgtcacacagaagcatatccgggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40736 - RNA, 296 nt, synthetic construct
  source 1..296: mol_type = other RNA
cgctcttccgcgtctcatgtacgtcggggacgtccgcagcgtcacacagaagcatatccagcggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40737 - RNA, 296 nt, synthetic construct
  source 1..296: mol_type = other RNA
cgctcttccgcgtctcatgtacgtcggggacgtccgcagcgtcacacagaagcatatccaggagcggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40738 - RNA, 296 nt, synthetic construct
  source 1..296: mol_type = other RNA
cgctcttccgcgtctcatgtacgtcggggacgtccgcagcgtcacacagaagcatatccaggagtggcggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40739 - RNA, 296 nt, synthetic construct
  source 1..296: mol_type = other RNA
cgctcttccgcgtctcatgtacgtcggggacgtccgcagcgtcacacagaagcatatccaggagtggggccggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40740 - RNA, 296 nt, synthetic construct
  source 1..296: mol_type = other RNA
cgctcttccgcgtctcatgtacgtcggggacgtccgcagcgtcacacagaagcatatccaggagtggggcccacgggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40741 - RNA, 296 nt, synthetic construct
  source 1..296: mol_type = other RNA
cgctcttccgcgtctcatgtacgtcggggacgtccgcagcgtcacacagaagcatatccaggagtggggcccattccggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40742 - RNA, 296 nt, synthetic construct
  source 1..296: mol_type = other RNA
cgctcttccgcgtctcatgtacgtcggggacgtccgcagcgtcacacagaagcatatccaggagtggggcccattcgaccgggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40743 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgcggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40744 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgcggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40745 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattcggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40746 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggacggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40747 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggccggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40748 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40749 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccccggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40750 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgccgggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40751 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaaccggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40752 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgaccggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40753 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctccggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40754 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcccgggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40755 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattcggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40756 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40757 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccgggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40758 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40759 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40760 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40761 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40762 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40763 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcgggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40764 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40765 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40766 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40767 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40768 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40769 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40770 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40771 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccgggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40772 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40773 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40774 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccggcgcctcctgcatgatgcgcggcccaaggagggagatgatcgccccttcttctggctctttgagaatgtggtggccatgggcgttagtgacaagagggacatcgagacgtcggaagagc

SEQ ID NO: 40775 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccggctcctgcatgatgcgcggcccaaggagggagatgatcgccccttcttctggctctttgagaatgtggtggccatgggcgttagtgacaagagggacatcgagacgtcggaagagc

SEQ ID NO: 40776 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccggctgcatgatgcgcggcccaaggagggagatgatcgccccttcttctggctctttgagaatgtggtggccatgggcgttagtgacaagagggacatcgagacgtcggaagagc

SEQ ID NO: 40777 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccggcatgatgcgcggcccaaggagggagatgatcgccccttcttctggctctttgagaatgtggtggccatgggcgttagtgacaagagggacatcgagacgtcggaagagc

SEQ ID NO: 40778 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcgggatgcgcggcccaaggagggagatgatcgccccttcttctggctctttgagaatgtggtggccatgggcgttagtgacaagagggacatcgagacgtcggaagagc

SEQ ID NO: 40779 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcgggcgcggcccaaggagggagatgatcgccccttcttctggctctttgagaatgtggtggccatgggcgttagtgacaagagggacatcgagacgtcggaagagc

SEQ ID NO: 40780 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcggcggcccaaggagggagatgatcgccccttcttctggctctttgagaatgtggtggccatgggcgttagtgacaagagggacatcgagacgtcggaagagc

SEQ ID NO: 40781 - RNA, 296 nt, synthetic construct; identical to SEQ ID NO: 38380
  source 1..296: mol_type = other RNA

SEQ ID NO: 40782 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcggaaggagggagatgatcgccccttcttctggctctttgagaatgtggtggccatgggcgttagtgacaagagggacatcgagacgtcggaagagc

SEQ ID NO: 40783 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccgggagggagatgatcgccccttcttctggctctttgagaatgtggtggccatgggcgttagtgacaagagggacatcgagacgtcggaagagc

SEQ ID NO: 40784 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcggggagatgatcgccccttcttctggctctttgagaatgtggtggccatgggcgttagtgacaagagggacatcgagacgtcggaagagc

SEQ ID NO: 40785 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcgggatgatcgccccttcttctggctctttgagaatgtggtggccatgggcgttagtgacaagagggacatcgagacgtcggaagagc

SEQ ID NO: 40786 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacgggatcgccccttcttctggctctttgagaatgtggtggccatgggcgttagtgacaagagggacatcgagacgtcggaagagc

SEQ ID NO: 40787 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcggcgccccttcttctggctctttgagaatgtggtggccatgggcgttagtgacaagagggacatcgagacgtcggaagagc

SEQ ID NO: 40788 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcggcccttcttctggctctttgagaatgtggtggccatgggcgttagtgacaagagggacatcgagacgtcggaagagc

SEQ ID NO: 40789 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccggttcttctggctctttgagaatgtggtggccatgggcgttagtgacaagagggacatcgagacgtcggaagagc

SEQ ID NO: 40790 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccggttctggctctttgagaatgtggtggccatgggcgttagtgacaagagggacatcgagacgtcggaagagc

SEQ ID NO: 40791 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccggtggctctttgagaatgtggtggccatgggcgttagtgacaagagggacatcgagacgtcggaagagc

SEQ ID NO: 40792 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccggctctttgagaatgtggtggccatgggcgttagtgacaagagggacatcgagacgtcggaagagc

SEQ ID NO: 40793 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcggtttgagaatgtggtggccatgggcgttagtgacaagagggacatcgagacgtcggaagagc

SEQ ID NO: 40794 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccgggagaatgtggtggccatgggcgttagtgacaagagggacatcgagacgtcggaagagc

SEQ ID NO: 40795 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcggaatgtggtggccatgggcgttagtgacaagagggacatcgagacgtcggaagagc

SEQ ID NO: 40796 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcgggtggtggccatgggcgttagtgacaagagggacatcgagacgtcggaagagc

SEQ ID NO: 40797 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcgggtggccatgggcgttagtgacaagagggacatcgagacgtcggaagagc

SEQ ID NO: 40798 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcgggccatgggcgttagtgacaagagggacatcgagacgtcggaagagc

SEQ ID NO: 40799 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcggatgggcgttagtgacaagagggacatcgagacgtcggaagagc

SEQ ID NO: 40800 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccggggcgttagtgacaagagggacatcgagacgtcggaagagc

SEQ ID NO: 40801 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcgggttagtgacaagagggacatcgagacgtcggaagagc

SEQ ID NO: 40802 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccggagtgacaagagggacatcgagacgtcggaagagc

SEQ ID NO: 40803 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcgggacaagagggacatcgagacgtcggaagagc

SEQ ID NO: 40804 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcggaagagggacatcgagacgtcggaagagc

SEQ ID NO: 40805 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccggagggacatcgagacgtcggaagagc

SEQ ID NO: 40806 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcgggacatcgagacgtcggaagagc

SEQ ID NO: 40807 - RNA, 296 nt, synthetic construct
  source 1..296: mol_type = other RNA
cgctcttccgcgtctcatgtaccgcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40808 - RNA, 296 nt, synthetic construct
  source 1..296: mol_type = other RNA
cgctcttccgcgtctcatgtacgtccgcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40809 - RNA, 296 nt, synthetic construct
  source 1..296: mol_type = other RNA
cgctcttccgcgtctcatgtacgtcgggcgcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40810 - RNA, 296 nt, synthetic construct
  source 1..296: mol_type = other RNA
cgctcttccgcgtctcatgtacgtcggggaccgccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40811 - RNA, 296 nt, synthetic construct; identical to SEQ ID NO: 38380
  source 1..296: mol_type = other RNA

SEQ ID NO: 40812 - RNA, 296 nt, synthetic construct
  source 1..296: mol_type = other RNA
cgctcttccgcgtctcatgtacgtcggggacgtccgccgcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40813 - RNA, 296 nt, synthetic construct
  source 1..296: mol_type = other RNA
cgctcttccgcgtctcatgtacgtcggggacgtccgcagccgcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40814 - RNA, 296 nt, synthetic construct
  source 1..296: mol_type = other RNA
cgctcttccgcgtctcatgtacgtcggggacgtccgcagcgtccgccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40815 - RNA, 296 nt, synthetic construct
  source 1..296: mol_type = other RNA
cgctcttccgcgtctcatgtacgtcggggacgtccgcagcgtcacacgcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40816 - RNA, 296 nt, synthetic construct
  source 1..296: mol_type = other RNA
cgctcttccgcgtctcatgtacgtcggggacgtccgcagcgtcacacagcgccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40817 - RNA, 296 nt, synthetic construct
  source 1..296: mol_type = other RNA
cgctcttccgcgtctcatgtacgtcggggacgtccgcagcgtcacacagaagcgcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40818 - RNA, 296 nt, synthetic construct
  source 1..296: mol_type = other RNA
cgctcttccgcgtctcatgtacgtcggggacgtccgcagcgtcacacagaagcatcgccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40819 - RNA, 296 nt, synthetic construct
  source 1..296: mol_type = other RNA
cgctcttccgcgtctcatgtacgtcggggacgtccgcagcgtcacacagaagcatatccgcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40820 - RNA, 296 nt, synthetic construct
  source 1..296: mol_type = other RNA
cgctcttccgcgtctcatgtacgtcggggacgtccgcagcgtcacacagaagcatatccagcgctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40821 - RNA, 296 nt, synthetic construct
  source 1..296: mol_type = other RNA
cgctcttccgcgtctcatgtacgtcggggacgtccgcagcgtcacacagaagcatatccaggagcgcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40822 - RNA, 296 nt, synthetic construct
  source 1..296: mol_type = other RNA
cgctcttccgcgtctcatgtacgtcggggacgtccgcagcgtcacacagaagcatatccaggagtggcgcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40823 - RNA, 296 nt, synthetic construct
  source 1..296: mol_type = other RNA
cgctcttccgcgtctcatgtacgtcggggacgtccgcagcgtcacacagaagcatatccaggagtggggccgcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40824 - RNA, 296 nt, synthetic construct
  source 1..296: mol_type = other RNA
cgctcttccgcgtctcatgtacgtcggggacgtccgcagcgtcacacagaagcatatccaggagtggggcccacgcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40825 - RNA, 296 nt, synthetic construct
  source 1..296: mol_type = other RNA
cgctcttccgcgtctcatgtacgtcggggacgtccgcagcgtcacacagaagcatatccaggagtggggcccattccgcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40826 - RNA, 296 nt, synthetic construct
  source 1..296: mol_type = other RNA
cgctcttccgcgtctcatgtacgtcggggacgtccgcagcgtcacacagaagcatatccaggagtggggcccattcgaccgcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40827 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgcgcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40828 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgcgcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40829 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattcgcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40830 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggacgcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40831 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggccgcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40832 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcgctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40833 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccccgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40834 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgccgcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40835 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaaccgcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40836 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgaccgctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40837 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctccgcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40838 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcccgcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40839 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattcgcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40840 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccgccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40841 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccgcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40842 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcgccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40843 - RNA, 296 nt, synthetic construct; identical to SEQ ID NO: 38380
  source 1..296: mol_type = other RNA

SEQ ID NO: 40844 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccgcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40845 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcgcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40846 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacgctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40847 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcgcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40848 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcgcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40849 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcgcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40850 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcgcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40851 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcgccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40852 - RNA, 296 nt, synthetic construct; identical to SEQ ID NO: 38380
  source 1..296: mol_type = other RNA

SEQ ID NO: 40853 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccgcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40854 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccgctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40855 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccgcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40856 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcgcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40857 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcgctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40858 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccgccgcctcctgcatgatgcgcggcccaaggagggagatgatcgccccttcttctggctctttgagaatgtggtggccatgggcgttagtgacaagagggacatcgagacgtcggaagagc

SEQ ID NO: 40859 - RNA, 296 nt, synthetic construct; identical to SEQ ID NO: 38380
  source 1..296: mol_type = other RNA

SEQ ID NO: 40860 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccgcctgcatgatgcgcggcccaaggagggagatgatcgccccttcttctggctctttgagaatgtggtggccatgggcgttagtgacaagagggacatcgagacgtcggaagagc

SEQ ID NO: 40861 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccgccatgatgcgcggcccaaggagggagatgatcgccccttcttctggctctttgagaatgtggtggccatgggcgttagtgacaagagggacatcgagacgtcggaagagc

SEQ ID NO: 40862 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcgcgatgcgcggcccaaggagggagatgatcgccccttcttctggctctttgagaatgtggtggccatgggcgttagtgacaagagggacatcgagacgtcggaagagc

SEQ ID NO: 40863 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcgcgcgcggcccaaggagggagatgatcgccccttcttctggctctttgagaatgtggtggccatgggcgttagtgacaagagggacatcgagacgtcggaagagc

SEQ ID NO: 40864 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcgccggcccaaggagggagatgatcgccccttcttctggctctttgagaatgtggtggccatgggcgttagtgacaagagggacatcgagacgtcggaagagc

SEQ ID NO: 40865 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgccccaaggagggagatgatcgccccttcttctggctctttgagaatgtggtggccatgggcgttagtgacaagagggacatcgagacgtcggaagagc

SEQ ID NO: 40866 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcgcaaggagggagatgatcgccccttcttctggctctttgagaatgtggtggccatgggcgttagtgacaagagggacatcgagacgtcggaagagc

SEQ ID NO: 40867 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccgcgagggagatgatcgccccttcttctggctctttgagaatgtggtggccatgggcgttagtgacaagagggacatcgagacgtcggaagagc

SEQ ID NO: 40868 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcgcggagatgatcgccccttcttctggctctttgagaatgtggtggccatgggcgttagtgacaagagggacatcgagacgtcggaagagc

SEQ ID NO: 40869 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcgcgatgatcgccccttcttctggctctttgagaatgtggtggccatgggcgttagtgacaagagggacatcgagacgtcggaagagc

SEQ ID NO: 40870 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacgcgatcgccccttcttctggctctttgagaatgtggtggccatgggcgttagtgacaagagggacatcgagacgtcggaagagc

SEQ ID NO: 40871 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcgccgccccttcttctggctctttgagaatgtggtggccatgggcgttagtgacaagagggacatcgagacgtcggaagagc

SEQ ID NO: 40872 - RNA, 296 nt, synthetic construct; identical to SEQ ID NO: 38380
  source 1..296: mol_type = other RNA

SEQ ID NO: 40873 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccgcttcttctggctctttgagaatgtggtggccatgggcgttagtgacaagagggacatcgagacgtcggaagagc

SEQ ID NO: 40874 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccgcttctggctctttgagaatgtggtggccatgggcgttagtgacaagagggacatcgagacgtcggaagagc

SEQ ID NO: 40875 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccgctggctctttgagaatgtggtggccatgggcgttagtgacaagagggacatcgagacgtcggaagagc

SEQ ID NO: 40876 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccgcctctttgagaatgtggtggccatgggcgttagtgacaagagggacatcgagacgtcggaagagc

SEQ ID NO: 40877 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcgctttgagaatgtggtggccatgggcgttagtgacaagagggacatcgagacgtcggaagagc

SEQ ID NO: 40878 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccgcgagaatgtggtggccatgggcgttagtgacaagagggacatcgagacgtcggaagagc

SEQ ID NO: 40879 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcgcaatgtggtggccatgggcgttagtgacaagagggacatcgagacgtcggaagagc

SEQ ID NO: 40880 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcgcgtggtggccatgggcgttagtgacaagagggacatcgagacgtcggaagagc

SEQ ID NO: 40881 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcgcgtggccatgggcgttagtgacaagagggacatcgagacgtcggaagagc

SEQ ID NO: 40882 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcgcgccatgggcgttagtgacaagagggacatcgagacgtcggaagagc

SEQ ID NO: 40883 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcgcatgggcgttagtgacaagagggacatcgagacgtcggaagagc

SEQ ID NO: 40884 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccgcggcgttagtgacaagagggacatcgagacgtcggaagagc

SEQ ID NO: 40885 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcgcgttagtgacaagagggacatcgagacgtcggaagagc

SEQ ID NO: 40886 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccgcagtgacaagagggacatcgagacgtcggaagagc

SEQ ID NO: 40887 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcgcgacaagagggacatcgagacgtcggaagagc

SEQ ID NO: 40888 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcgcaagagggacatcgagacgtcggaagagc

SEQ ID NO: 40889 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccgcagggacatcgagacgtcggaagagc

SEQ ID NO: 40890 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcgcgacatcgagacgtcggaagagc

SEQ ID NO: 40891 - RNA, 296 nt, synthetic construct
  source 1..296: mol_type = other RNA
cgctcttccgcgtctcatgtacccgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40892 - RNA, 296 nt, synthetic construct
  source 1..296: mol_type = other RNA
cgctcttccgcgtctcatgtacgtcccggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40893 - RNA, 296 nt, synthetic construct
  source 1..296: mol_type = other RNA
cgctcttccgcgtctcatgtacgtcgggccggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40894 - RNA, 296 nt, synthetic construct
  source 1..296: mol_type = other RNA
cgctcttccgcgtctcatgtacgtcggggacccgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40895 - RNA, 296 nt, synthetic construct
  source 1..296: mol_type = other RNA
cgctcttccgcgtctcatgtacgtcggggacgtcccgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40896 - RNA, 296 nt, synthetic construct
  source 1..296: mol_type = other RNA
cgctcttccgcgtctcatgtacgtcggggacgtccgcccggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40897 - RNA, 296 nt, synthetic construct
  source 1..296: mol_type = other RNA
cgctcttccgcgtctcatgtacgtcggggacgtccgcagcccgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40898 - RNA, 296 nt, synthetic construct
  source 1..296: mol_type = other RNA
cgctcttccgcgtctcatgtacgtcggggacgtccgcagcgtcccgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40899 - RNA, 296 nt, synthetic construct
  source 1..296: mol_type = other RNA
cgctcttccgcgtctcatgtacgtcggggacgtccgcagcgtcacaccgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40900 - RNA, 296 nt, synthetic construct
  source 1..296: mol_type = other RNA
cgctcttccgcgtctcatgtacgtcggggacgtccgcagcgtcacacagccgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40901 - RNA, 296 nt, synthetic construct
  source 1..296: mol_type = other RNA
cgctcttccgcgtctcatgtacgtcggggacgtccgcagcgtcacacagaagccgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40902 - RNA, 296 nt, synthetic construct
  source 1..296: mol_type = other RNA
cgctcttccgcgtctcatgtacgtcggggacgtccgcagcgtcacacagaagcatccgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40903 - RNA, 296 nt, synthetic construct
  source 1..296: mol_type = other RNA
cgctcttccgcgtctcatgtacgtcggggacgtccgcagcgtcacacagaagcatatcccggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40904 - RNA, 296 nt, synthetic construct
  source 1..296: mol_type = other RNA
cgctcttccgcgtctcatgtacgtcggggacgtccgcagcgtcacacagaagcatatccagccgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40905 - RNA, 296 nt, synthetic construct
  source 1..296: mol_type = other RNA
cgctcttccgcgtctcatgtacgtcggggacgtccgcagcgtcacacagaagcatatccaggagccgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40906 - RNA, 296 nt, synthetic construct
  source 1..296: mol_type = other RNA
cgctcttccgcgtctcatgtacgtcggggacgtccgcagcgtcacacagaagcatatccaggagtggccgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40907 - RNA, 296 nt, synthetic construct
  source 1..296: mol_type = other RNA
cgctcttccgcgtctcatgtacgtcggggacgtccgcagcgtcacacagaagcatatccaggagtggggcccgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40908 - RNA, 296 nt, synthetic construct
  source 1..296: mol_type = other RNA
cgctcttccgcgtctcatgtacgtcggggacgtccgcagcgtcacacagaagcatatccaggagtggggcccaccggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40909 - RNA, 296 nt, synthetic construct
  source 1..296: mol_type = other RNA
cgctcttccgcgtctcatgtacgtcggggacgtccgcagcgtcacacagaagcatatccaggagtggggcccattcccgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40910 - RNA, 296 nt, synthetic construct
  source 1..296: mol_type = other RNA
cgctcttccgcgtctcatgtacgtcggggacgtccgcagcgtcacacagaagcatatccaggagtggggcccattcgacccggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40911 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgccgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40912 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgccgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40913 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattccgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40914 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaccgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40915 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcccgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40916 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40917 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtcccccgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40918 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcccggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40919 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacccgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40920 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacccgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40921 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctcccgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40922 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccccggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40923 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattccgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40924 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcccgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40925 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40926 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctccgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40927 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccccgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40928 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcccgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40929 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagccgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40930 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaccgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40931 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttccggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40932 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatccgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40933 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagccgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40934 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtccgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40935 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactccgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40936 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcccgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40937 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcccgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40938 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcccgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40939 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcccggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40940 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttccgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40941 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagccgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40942 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcccgcgcctcctgcatgatgcgcggcccaaggagggagatgatcgccccttcttctggctctttgagaatgtggtggccatgggcgttagtgacaagagggacatcgagacgtcggaagagc

SEQ ID NO: 40943 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacccgctcctgcatgatgcgcggcccaaggagggagatgatcgccccttcttctggctctttgagaatgtggtggccatgggcgttagtgacaagagggacatcgagacgtcggaagagc

SEQ ID NO: 40944 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcccgctgcatgatgcgcggcccaaggagggagatgatcgccccttcttctggctctttgagaatgtggtggccatgggcgttagtgacaagagggacatcgagacgtcggaagagc

SEQ ID NO: 40945 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcccgcatgatgcgcggcccaaggagggagatgatcgccccttcttctggctctttgagaatgtggtggccatgggcgttagtgacaagagggacatcgagacgtcggaagagc

SEQ ID NO: 40946 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgccggatgcgcggcccaaggagggagatgatcgccccttcttctggctctttgagaatgtggtggccatgggcgttagtgacaagagggacatcgagacgtcggaagagc

SEQ ID NO: 40947 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatccggcgcggcccaaggagggagatgatcgccccttcttctggctctttgagaatgtggtggccatgggcgttagtgacaagagggacatcgagacgtcggaagagc

SEQ ID NO: 40948 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatccgcggcccaaggagggagatgatcgccccttcttctggctctttgagaatgtggtggccatgggcgttagtgacaagagggacatcgagacgtcggaagagc

SEQ ID NO: 40949 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgccgcccaaggagggagatgatcgccccttcttctggctctttgagaatgtggtggccatgggcgttagtgacaagagggacatcgagacgtcggaagagc

SEQ ID NO: 40950 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccgaaggagggagatgatcgccccttcttctggctctttgagaatgtggtggccatgggcgttagtgacaagagggacatcgagacgtcggaagagc

SEQ ID NO: 40951 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccccggagggagatgatcgccccttcttctggctctttgagaatgtggtggccatgggcgttagtgacaagagggacatcgagacgtcggaagagc

SEQ ID NO: 40952 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagccgggagatgatcgccccttcttctggctctttgagaatgtggtggccatgggcgttagtgacaagagggacatcgagacgtcggaagagc

SEQ ID NO: 40953 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagccggatgatcgccccttcttctggctctttgagaatgtggtggccatgggcgttagtgacaagagggacatcgagacgtcggaagagc

SEQ ID NO: 40954 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaccggatcgccccttcttctggctctttgagaatgtggtggccatgggcgttagtgacaagagggacatcgagacgtcggaagagc

SEQ ID NO: 40955 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatccgcgccccttcttctggctctttgagaatgtggtggccatgggcgttagtgacaagagggacatcgagacgtcggaagagc

SEQ ID NO: 40956 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatccgcccttcttctggctctttgagaatgtggtggccatgggcgttagtgacaagagggacatcgagacgtcggaagagc

SEQ ID NO: 40957 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccgttcttctggctctttgagaatgtggtggccatgggcgttagtgacaagagggacatcgagacgtcggaagagc

SEQ ID NO: 40958 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccccgttctggctctttgagaatgtggtggccatgggcgttagtgacaagagggacatcgagacgtcggaagagc

SEQ ID NO: 40959 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcccgtggctctttgagaatgtggtggccatgggcgttagtgacaagagggacatcgagacgtcggaagagc

SEQ ID NO: 40960 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcccgctctttgagaatgtggtggccatgggcgttagtgacaagagggacatcgagacgtcggaagagc

SEQ ID NO: 40961 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggccgtttgagaatgtggtggccatgggcgttagtgacaagagggacatcgagacgtcggaagagc

SEQ ID NO: 40962 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcccggagaatgtggtggccatgggcgttagtgacaagagggacatcgagacgtcggaagagc

SEQ ID NO: 40963 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttccgaatgtggtggccatgggcgttagtgacaagagggacatcgagacgtcggaagagc

SEQ ID NO: 40964 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagccggtggtggccatgggcgttagtgacaagagggacatcgagacgtcggaagagc

SEQ ID NO: 40965 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatccggtggccatgggcgttagtgacaagagggacatcgagacgtcggaagagc

SEQ ID NO: 40966 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgccggccatgggcgttagtgacaagagggacatcgagacgtcggaagagc

SEQ ID NO: 40967 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgccgatgggcgttagtgacaagagggacatcgagacgtcggaagagc

SEQ ID NO: 40968 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccccgggcgttagtgacaagagggacatcgagacgtcggaagagc

SEQ ID NO: 40969 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgccggttagtgacaagagggacatcgagacgtcggaagagc

SEQ ID NO: 40970 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcccgagtgacaagagggacatcgagacgtcggaagagc

SEQ ID NO: 40971 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttccggacaagagggacatcgagacgtcggaagagc

SEQ ID NO: 40972 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtccgaagagggacatcgagacgtcggaagagc

SEQ ID NO: 40973 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacccgagggacatcgagacgtcggaagagc

SEQ ID NO: 40974 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagccggacatcgagacgtcggaagagc

SEQ ID NO: 40975 - RNA, 296 nt, synthetic construct
  source 1..296: mol_type = other RNA
cgctcttccgcgtctcatgtaccccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40976 - RNA, 296 nt, synthetic construct
  source 1..296: mol_type = other RNA
cgctcttccgcgtctcatgtacgtccccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40977 - RNA, 296 nt, synthetic construct
  source 1..296: mol_type = other RNA
cgctcttccgcgtctcatgtacgtcgggcccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40978 - RNA, 296 nt, synthetic construct
  source 1..296: mol_type = other RNA
cgctcttccgcgtctcatgtacgtcggggacccccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40979 - RNA, 296 nt, synthetic construct
  source 1..296: mol_type = other RNA
cgctcttccgcgtctcatgtacgtcggggacgtccccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40980 - RNA, 296 nt, synthetic construct
  source 1..296: mol_type = other RNA
cgctcttccgcgtctcatgtacgtcggggacgtccgccccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40981 - RNA, 296 nt, synthetic construct
  source 1..296: mol_type = other RNA
cgctcttccgcgtctcatgtacgtcggggacgtccgcagccccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40982 - RNA, 296 nt, synthetic construct
  source 1..296: mol_type = other RNA
cgctcttccgcgtctcatgtacgtcggggacgtccgcagcgtcccccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40983 - RNA, 296 nt, synthetic construct
  source 1..296: mol_type = other RNA
cgctcttccgcgtctcatgtacgtcggggacgtccgcagcgtcacacccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40984 - RNA, 296 nt, synthetic construct
  source 1..296: mol_type = other RNA
cgctcttccgcgtctcatgtacgtcggggacgtccgcagcgtcacacagccccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40985 - RNA, 296 nt, synthetic construct
  source 1..296: mol_type = other RNA
cgctcttccgcgtctcatgtacgtcggggacgtccgcagcgtcacacagaagcccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40986 - RNA, 296 nt, synthetic construct
  source 1..296: mol_type = other RNA
cgctcttccgcgtctcatgtacgtcggggacgtccgcagcgtcacacagaagcatccccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40987 - RNA, 296 nt, synthetic construct
  source 1..296: mol_type = other RNA
cgctcttccgcgtctcatgtacgtcggggacgtccgcagcgtcacacagaagcatatccccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40988 - RNA, 296 nt, synthetic construct
  source 1..296: mol_type = other RNA
cgctcttccgcgtctcatgtacgtcggggacgtccgcagcgtcacacagaagcatatccagccctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40989 - RNA, 296 nt, synthetic construct
  source 1..296: mol_type = other RNA
cgctcttccgcgtctcatgtacgtcggggacgtccgcagcgtcacacagaagcatatccaggagcccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40990 - RNA, 296 nt, synthetic construct
  source 1..296: mol_type = other RNA
cgctcttccgcgtctcatgtacgtcggggacgtccgcagcgtcacacagaagcatatccaggagtggcccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40991 - RNA, 296 nt, synthetic construct
  source 1..296: mol_type = other RNA
cgctcttccgcgtctcatgtacgtcggggacgtccgcagcgtcacacagaagcatatccaggagtggggccccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40992 - RNA, 296 nt, synthetic construct
  source 1..296: mol_type = other RNA
cgctcttccgcgtctcatgtacgtcggggacgtccgcagcgtcacacagaagcatatccaggagtggggcccacccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40993 - RNA, 296 nt, synthetic construct
  source 1..296: mol_type = other RNA
cgctcttccgcgtctcatgtacgtcggggacgtccgcagcgtcacacagaagcatatccaggagtggggcccattccccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40994 - RNA, 296 nt, synthetic construct
  source 1..296: mol_type = other RNA
cgctcttccgcgtctcatgtacgtcggggacgtccgcagcgtcacacagaagcatatccaggagtggggcccattcgaccccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40995 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctgcccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40996 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgcccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40997 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattcccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40998 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggacccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 40999 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggccccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41000 - RNA, 296 nt, synthetic construct; identical to SEQ ID NO: 38380
  source 1..296: mol_type = other RNA

SEQ ID NO: 41001 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccccccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41002 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgccccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41003 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaaccccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41004 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacccctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41005 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctccccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41006 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctcccccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41007 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattcccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41008 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcccccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41009 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41010 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctccccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41011 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41012 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41013 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41014 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaccctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41015 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41016 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41017 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41018 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41019 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactccccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41020 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41021 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41022 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcccctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41023 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41024 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41025 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagccctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41026 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcccccgcctcctgcatgatgcgcggcccaaggagggagatgatcgccccttcttctggctctttgagaatgtggtggccatgggcgttagtgacaagagggacatcgagacgtcggaagagc

SEQ ID NO: 41027 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccccctcctgcatgatgcgcggcccaaggagggagatgatcgccccttcttctggctctttgagaatgtggtggccatgggcgttagtgacaagagggacatcgagacgtcggaagagc

SEQ ID NO: 41028 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccccctgcatgatgcgcggcccaaggagggagatgatcgccccttcttctggctctttgagaatgtggtggccatgggcgttagtgacaagagggacatcgagacgtcggaagagc

SEQ ID NO: 41029 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcccccatgatgcgcggcccaaggagggagatgatcgccccttcttctggctctttgagaatgtggtggccatgggcgttagtgacaagagggacatcgagacgtcggaagagc

SEQ ID NO: 41030 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcccgatgcgcggcccaaggagggagatgatcgccccttcttctggctctttgagaatgtggtggccatgggcgttagtgacaagagggacatcgagacgtcggaagagc

SEQ ID NO: 41031 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcccgcgcggcccaaggagggagatgatcgccccttcttctggctctttgagaatgtggtggccatgggcgttagtgacaagagggacatcgagacgtcggaagagc

SEQ ID NO: 41032 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatccccggcccaaggagggagatgatcgccccttcttctggctctttgagaatgtggtggccatgggcgttagtgacaagagggacatcgagacgtcggaagagc

SEQ ID NO: 41033 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgccccccaaggagggagatgatcgccccttcttctggctctttgagaatgtggtggccatgggcgttagtgacaagagggacatcgagacgtcggaagagc

SEQ ID NO: 41034 - RNA, 296 nt, synthetic construct; identical to SEQ ID NO: 38380
  source 1..296: mol_type = other RNA

SEQ ID NO: 41035 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccccgagggagatgatcgccccttcttctggctctttgagaatgtggtggccatgggcgttagtgacaagagggacatcgagacgtcggaagagc

SEQ ID NO: 41036 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcccggagatgatcgccccttcttctggctctttgagaatgtggtggccatgggcgttagtgacaagagggacatcgagacgtcggaagagc

SEQ ID NO: 41037 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcccgatgatcgccccttcttctggctctttgagaatgtggtggccatgggcgttagtgacaagagggacatcgagacgtcggaagagc

SEQ ID NO: 41038 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacccgatcgccccttcttctggctctttgagaatgtggtggccatgggcgttagtgacaagagggacatcgagacgtcggaagagc

SEQ ID NO: 41039 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatccccgccccttcttctggctctttgagaatgtggtggccatgggcgttagtgacaagagggacatcgagacgtcggaagagc

SEQ ID NO: 41040 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatccccccttcttctggctctttgagaatgtggtggccatgggcgttagtgacaagagggacatcgagacgtcggaagagc

SEQ ID NO: 41041 - RNA, 296 nt, synthetic construct; identical to SEQ ID NO: 38380
  source 1..296: mol_type = other RNA

SEQ ID NO: 41042 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccccttctggctctttgagaatgtggtggccatgggcgttagtgacaagagggacatcgagacgtcggaagagc

SEQ ID NO: 41043 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcccctggctctttgagaatgtggtggccatgggcgttagtgacaagagggacatcgagacgtcggaagagc

SEQ ID NO: 41044 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccccctctttgagaatgtggtggccatgggcgttagtgacaagagggacatcgagacgtcggaagagc

SEQ ID NO: 41045 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggccctttgagaatgtggtggccatgggcgttagtgacaagagggacatcgagacgtcggaagagc

SEQ ID NO: 41046 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccccgagaatgtggtggccatgggcgttagtgacaagagggacatcgagacgtcggaagagc

SEQ ID NO: 41047 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcccaatgtggtggccatgggcgttagtgacaagagggacatcgagacgtcggaagagc

SEQ ID NO: 41048 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcccgtggtggccatgggcgttagtgacaagagggacatcgagacgtcggaagagc

SEQ ID NO: 41049 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcccgtggccatgggcgttagtgacaagagggacatcgagacgtcggaagagc

SEQ ID NO: 41050 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcccgccatgggcgttagtgacaagagggacatcgagacgtcggaagagc

SEQ ID NO: 41051 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcccatgggcgttagtgacaagagggacatcgagacgtcggaagagc

SEQ ID NO: 41052 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccccggcgttagtgacaagagggacatcgagacgtcggaagagc

SEQ ID NO: 41053 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcccgttagtgacaagagggacatcgagacgtcggaagagc

SEQ ID NO: 41054 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccccagtgacaagagggacatcgagacgtcggaagagc

SEQ ID NO: 41055 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcccgacaagagggacatcgagacgtcggaagagc

SEQ ID NO: 41056 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcccaagagggacatcgagacgtcggaagagc

SEQ ID NO: 41057 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccccagggacatcgagacgtcggaagagc

SEQ ID NO: 41058 - RNA, 296 nt, synthetic construct
  source 1..296: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcccgacatcgagacgtcggaagagc

SEQ ID NO: 41059 - RNA, 299 nt, synthetic construct
  source 1..299: mol_type = other RNA
cgctcttccgcgtctcatgtacgtcaagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41060 - RNA, 299 nt, synthetic construct
  source 1..299: mol_type = other RNA
cgctcttccgcgtctcatgtacgtcgggaaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41061 - RNA, 299 nt, synthetic construct
  source 1..299: mol_type = other RNA
cgctcttccgcgtctcatgtacgtcggggacaaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41062 - RNA, 299 nt, synthetic construct
  source 1..299: mol_type = other RNA
cgctcttccgcgtctcatgtacgtcggggacgtcaagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41063 - RNA, 299 nt, synthetic construct
  source 1..299: mol_type = other RNA
cgctcttccgcgtctcatgtacgtcggggacgtccgcaagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41064 - RNA, 299 nt, synthetic construct
  source 1..299: mol_type = other RNA
cgctcttccgcgtctcatgtacgtcggggacgtccgcagcaaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41065 - RNA, 299 nt, synthetic construct
  source 1..299: mol_type = other RNA
cgctcttccgcgtctcatgtacgtcggggacgtccgcagcgtcaagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41066 - RNA, 299 nt, synthetic construct
  source 1..299: mol_type = other RNA
cgctcttccgcgtctcatgtacgtcggggacgtccgcagcgtcacaaagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41067 - RNA, 299 nt, synthetic construct
  source 1..299: mol_type = other RNA
cgctcttccgcgtctcatgtacgtcggggacgtccgcagcgtcacacagaagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41068 - RNA, 299 nt, synthetic construct; identical to SEQ ID NO: 41067
  source 1..299: mol_type = other RNA

SEQ ID NO: 41069 - RNA, 299 nt, synthetic construct
  source 1..299: mol_type = other RNA
cgctcttccgcgtctcatgtacgtcggggacgtccgcagcgtcacacagaagcataagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41070 - RNA, 299 nt, synthetic construct
  source 1..299: mol_type = other RNA
cgctcttccgcgtctcatgtacgtcggggacgtccgcagcgtcacacagaagcatatcaagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41071 - RNA, 299 nt, synthetic construct
  source 1..299: mol_type = other RNA
cgctcttccgcgtctcatgtacgtcggggacgtccgcagcgtcacacagaagcatatccagaaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41072 - RNA, 299 nt, synthetic construct
  source 1..299: mol_type = other RNA
cgctcttccgcgtctcatgtacgtcggggacgtccgcagcgtcacacagaagcatatccaggagaagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41073 - RNA, 299 nt, synthetic construct
  source 1..299: mol_type = other RNA
cgctcttccgcgtctcatgtacgtcggggacgtccgcagcgtcacacagaagcatatccaggagtggaagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41074 - RNA, 299 nt, synthetic construct
  source 1..299: mol_type = other RNA
cgctcttccgcgtctcatgtacgtcggggacgtccgcagcgtcacacagaagcatatccaggagtggggcaagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41075 - RNA, 299 nt, synthetic construct
  source 1..299: mol_type = other RNA
cgctcttccgcgtctcatgtacgtcggggacgtccgcagcgtcacacagaagcatatccaggagtggggcccaaagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41076 - RNA, 299 nt, synthetic construct
  source 1..299: mol_type = other RNA
cgctcttccgcgtctcatgtacgtcggggacgtccgcagcgtcacacagaagcatatccaggagtggggcccattcaaggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41077 - RNA, 299 nt, synthetic construct
  source 1..299: mol_type = other RNA
cgctcttccgcgtctcatgtacgtcggggacgtccgcagcgtcacacagaagcatatccaggagtggggcccattcgacaagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41078 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgaaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41079 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgaagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41080 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattaagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41081 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaaagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41082 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcaagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41083 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtaagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41084 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccaagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41085 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41086 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacaaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41087 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacaagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41088 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcaagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41089 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccaagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41090 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattaaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41091 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41092 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacaagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41093 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctaaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41094 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41095 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41096 - RNA, 299 nt, synthetic construct; identical to SEQ ID NO: 41095
  source 1..299: mol_type = other RNA

SEQ ID NO: 41097 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaaagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41098 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttaagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41099 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttataaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41100 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41101 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41102 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactaagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41103 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcaagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41104 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41105 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcaagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41106 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcaagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41107 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttaaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41108 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagaagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41109 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcaagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41110 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacaagcgcctcctgcatgatgcgcggcccaaggagggagatgatcgccccttcttctggctctttgagaatgtggtggccatgggcgttagtgacaagagggacatcgagacgtcggaagagc

SEQ ID NO: 41111 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaagctcctgcatgatgcgcggcccaaggagggagatgatcgccccttcttctggctctttgagaatgtggtggccatgggcgttagtgacaagagggacatcgagacgtcggaagagc

SEQ ID NO: 41112 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcaagctgcatgatgcgcggcccaaggagggagatgatcgccccttcttctggctctttgagaatgtggtggccatgggcgttagtgacaagagggacatcgagacgtcggaagagc

SEQ ID NO: 41113 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgaagcatgatgcgcggcccaaggagggagatgatcgccccttcttctggctctttgagaatgtggtggccatgggcgttagtgacaagagggacatcgagacgtcggaagagc

SEQ ID NO: 41114 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcataaggatgcgcggcccaaggagggagatgatcgccccttcttctggctctttgagaatgtggtggccatgggcgttagtgacaagagggacatcgagacgtcggaagagc

SEQ ID NO: 41115 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgataaggcgcggcccaaggagggagatgatcgccccttcttctggctctttgagaatgtggtggccatgggcgttagtgacaagagggacatcgagacgtcggaagagc

SEQ ID NO: 41116 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgaagcggcccaaggagggagatgatcgccccttcttctggctctttgagaatgtggtggccatgggcgttagtgacaagagggacatcgagacgtcggaagagc

SEQ ID NO: 41117 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaagcccaaggagggagatgatcgccccttcttctggctctttgagaatgtggtggccatgggcgttagtgacaagagggacatcgagacgtcggaagagc

SEQ ID NO: 41118 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagaaggagggagatgatcgccccttcttctggctctttgagaatgtggtggccatgggcgttagtgacaagagggacatcgagacgtcggaagagc

SEQ ID NO: 41119 - RNA, 299 nt, synthetic construct; identical to SEQ ID NO: 41118
  source 1..299: mol_type = other RNA

SEQ ID NO: 41120 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagaagggagatgatcgccccttcttctggctctttgagaatgtggtggccatgggcgttagtgacaagagggacatcgagacgtcggaagagc

SEQ ID NO: 41121 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaaaggatgatcgccccttcttctggctctttgagaatgtggtggccatgggcgttagtgacaagagggacatcgagacgtcggaagagc

SEQ ID NO: 41122 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagataaggatcgccccttcttctggctctttgagaatgtggtggccatgggcgttagtgacaagagggacatcgagacgtcggaagagc

SEQ ID NO: 41123 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgataagcgccccttcttctggctctttgagaatgtggtggccatgggcgttagtgacaagagggacatcgagacgtcggaagagc

SEQ ID NO: 41124 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcaagcccttcttctggctctttgagaatgtggtggccatgggcgttagtgacaagagggacatcgagacgtcggaagagc

SEQ ID NO: 41125 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaagttcttctggctctttgagaatgtggtggccatgggcgttagtgacaagagggacatcgagacgtcggaagagc

SEQ ID NO: 41126 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcaagttctggctctttgagaatgtggtggccatgggcgttagtgacaagagggacatcgagacgtcggaagagc

SEQ ID NO: 41127 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcaagtggctctttgagaatgtggtggccatgggcgttagtgacaagagggacatcgagacgtcggaagagc

SEQ ID NO: 41128 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggaagctctttgagaatgtggtggccatgggcgttagtgacaagagggacatcgagacgtcggaagagc

SEQ ID NO: 41129 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcaagtttgagaatgtggtggccatgggcgttagtgacaagagggacatcgagacgtcggaagagc

SEQ ID NO: 41130 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaaggagaatgtggtggccatgggcgttagtgacaagagggacatcgagacgtcggaagagc

SEQ ID NO: 41131 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaagaatgtggtggccatgggcgttagtgacaagagggacatcgagacgtcggaagagc

SEQ ID NO: 41132 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaataaggtggtggccatgggcgttagtgacaagagggacatcgagacgtcggaagagc

SEQ ID NO: 41133 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgaaggtggccatgggcgttagtgacaagagggacatcgagacgtcggaagagc

SEQ ID NO: 41134 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgaaggccatgggcgttagtgacaagagggacatcgagacgtcggaagagc

SEQ ID NO: 41135 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaagatgggcgttagtgacaagagggacatcgagacgtcggaagagc

SEQ ID NO: 41136 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgaagggcgttagtgacaagagggacatcgagacgtcggaagagc

SEQ ID NO: 41137 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcaaggttagtgacaagagggacatcgagacgtcggaagagc

SEQ ID NO: 41138 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttaagagtgacaagagggacatcgagacgtcggaagagc

SEQ ID NO: 41139 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaaggacaagagggacatcgagacgtcggaagagc

SEQ ID NO: 41140 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaagagggacatcgagacgtcggaagagc

SEQ ID NO: 41141 - RNA, 299 nt, synthetic construct; identical to SEQ ID NO: 41140
  source 1..299: mol_type = other RNA

SEQ ID NO: 41142 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggaaggacatcgagacgtcggaagagc

SEQ ID NO: 41143 - RNA, 299 nt, synthetic construct
  source 1..299: mol_type = other RNA
cgctcttccgcgtctcatgtacgtcaacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41144 - RNA, 299 nt, synthetic construct
  source 1..299: mol_type = other RNA
cgctcttccgcgtctcatgtacgtcgggaacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41145 - RNA, 299 nt, synthetic construct
  source 1..299: mol_type = other RNA
cgctcttccgcgtctcatgtacgtcggggacaacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41146 - RNA, 299 nt, synthetic construct
  source 1..299: mol_type = other RNA
cgctcttccgcgtctcatgtacgtcggggacgtcaaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41147 - RNA, 299 nt, synthetic construct
  source 1..299: mol_type = other RNA
cgctcttccgcgtctcatgtacgtcggggacgtccgcaacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41148 - RNA, 299 nt, synthetic construct
  source 1..299: mol_type = other RNA
cgctcttccgcgtctcatgtacgtcggggacgtccgcagcaacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41149 - RNA, 299 nt, synthetic construct
  source 1..299: mol_type = other RNA
cgctcttccgcgtctcatgtacgtcggggacgtccgcagcgtcaacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41150 - RNA, 299 nt, synthetic construct
  source 1..299: mol_type = other RNA
cgctcttccgcgtctcatgtacgtcggggacgtccgcagcgtcacaaaccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41151 - RNA, 299 nt, synthetic construct
  source 1..299: mol_type = other RNA
cgctcttccgcgtctcatgtacgtcggggacgtccgcagcgtcacacagaacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41152 - RNA, 299 nt, synthetic construct
  source 1..299: mol_type = other RNA
cgctcttccgcgtctcatgtacgtcggggacgtccgcagcgtcacacagaagaaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41153 - RNA, 299 nt, synthetic construct
  source 1..299: mol_type = other RNA
cgctcttccgcgtctcatgtacgtcggggacgtccgcagcgtcacacagaagcataacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41154 - RNA, 299 nt, synthetic construct
  source 1..299: mol_type = other RNA
cgctcttccgcgtctcatgtacgtcggggacgtccgcagcgtcacacagaagcatatcaaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41155 - RNA, 299 nt, synthetic construct
  source 1..299: mol_type = other RNA
cgctcttccgcgtctcatgtacgtcggggacgtccgcagcgtcacacagaagcatatccagaacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41156 - RNA, 299 nt, synthetic construct
  source 1..299: mol_type = other RNA
cgctcttccgcgtctcatgtacgtcggggacgtccgcagcgtcacacagaagcatatccaggagaactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41157 - RNA, 299 nt, synthetic construct
  source 1..299: mol_type = other RNA
cgctcttccgcgtctcatgtacgtcggggacgtccgcagcgtcacacagaagcatatccaggagtggaacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41158 - RNA, 299 nt, synthetic construct
  source 1..299: mol_type = other RNA
cgctcttccgcgtctcatgtacgtcggggacgtccgcagcgtcacacagaagcatatccaggagtggggcaacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41159 - RNA, 299 nt, synthetic construct
  source 1..299: mol_type = other RNA
cgctcttccgcgtctcatgtacgtcggggacgtccgcagcgtcacacagaagcatatccaggagtggggcccaaacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41160 - RNA, 299 nt, synthetic construct
  source 1..299: mol_type = other RNA
cgctcttccgcgtctcatgtacgtcggggacgtccgcagcgtcacacagaagcatatccaggagtggggcccattcaacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41161 - RNA, 299 nt, synthetic construct
  source 1..299: mol_type = other RNA
cgctcttccgcgtctcatgtacgtcggggacgtccgcagcgtcacacagaagcatatccaggagtggggcccattcgacaacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41162 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgaacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41163 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgaacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41164 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattaacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41165 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaaacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41166 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcaacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41167 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtaacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41168 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccaactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41169 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41170 - RNA, 299 nt, synthetic construct; identical to SEQ ID NO: 41169
  source 1..299: mol_type = other RNA

SEQ ID NO: 41171 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacaacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41172 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcaactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41173 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccaacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41174 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattaacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41175 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41176 - RNA, 299 nt, synthetic construct; identical to SEQ ID NO: 41175
  source 1..299: mol_type = other RNA

SEQ ID NO: 41177 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctaacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41178 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41179 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41180 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41181 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaaacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41182 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttaactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41183 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttataacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41184 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41185 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41186 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactaacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41187 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcaaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41188 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41189 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcaacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41190 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcaactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41191 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttaacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41192 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagaacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41193 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcaactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41194 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacaaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41195 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaacctcctgcatgatgcgcggcccaaggagggagatgatcgccccttcttctggctctttgagaatgtggtggccatgggcgttagtgacaagagggacatcgagacgtcggaagagc

SEQ ID NO: 41196 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcaacctgcatgatgcgcggcccaaggagggagatgatcgccccttcttctggctctttgagaatgtggtggccatgggcgttagtgacaagagggacatcgagacgtcggaagagc

SEQ ID NO: 41197 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgaaccatgatgcgcggcccaaggagggagatgatcgccccttcttctggctctttgagaatgtggtggccatgggcgttagtgacaagagggacatcgagacgtcggaagagc

SEQ ID NO: 41198 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcataacgatgcgcggcccaaggagggagatgatcgccccttcttctggctctttgagaatgtggtggccatgggcgttagtgacaagagggacatcgagacgtcggaagagc

SEQ ID NO: 41199 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgataacgcgcggcccaaggagggagatgatcgccccttcttctggctctttgagaatgtggtggccatgggcgttagtgacaagagggacatcgagacgtcggaagagc

SEQ ID NO: 41200 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgaaccggcccaaggagggagatgatcgccccttcttctggctctttgagaatgtggtggccatgggcgttagtgacaagagggacatcgagacgtcggaagagc

SEQ ID NO: 41201 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaaccccaaggagggagatgatcgccccttcttctggctctttgagaatgtggtggccatgggcgttagtgacaagagggacatcgagacgtcggaagagc

SEQ ID NO: 41202 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaacaaggagggagatgatcgccccttcttctggctctttgagaatgtggtggccatgggcgttagtgacaagagggacatcgagacgtcggaagagc

SEQ ID NO: 41203 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagaacgagggagatgatcgccccttcttctggctctttgagaatgtggtggccatgggcgttagtgacaagagggacatcgagacgtcggaagagc

SEQ ID NO: 41204 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagaacggagatgatcgccccttcttctggctctttgagaatgtggtggccatgggcgttagtgacaagagggacatcgagacgtcggaagagc

SEQ ID NO: 41205 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaaacgatgatcgccccttcttctggctctttgagaatgtggtggccatgggcgttagtgacaagagggacatcgagacgtcggaagagc

SEQ ID NO: 41206 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagataacgatcgccccttcttctggctctttgagaatgtggtggccatgggcgttagtgacaagagggacatcgagacgtcggaagagc

SEQ ID NO: 41207 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgataaccgccccttcttctggctctttgagaatgtggtggccatgggcgttagtgacaagagggacatcgagacgtcggaagagc

SEQ ID NO: 41208 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcaaccccttcttctggctctttgagaatgtggtggccatgggcgttagtgacaagagggacatcgagacgtcggaagagc

SEQ ID NO: 41209 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaacttcttctggctctttgagaatgtggtggccatgggcgttagtgacaagagggacatcgagacgtcggaagagc

SEQ ID NO: 41210 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcaacttctggctctttgagaatgtggtggccatgggcgttagtgacaagagggacatcgagacgtcggaagagc

SEQ ID NO: 41211 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcaactggctctttgagaatgtggtggccatgggcgttagtgacaagagggacatcgagacgtcggaagagc

SEQ ID NO: 41212 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggaacctctttgagaatgtggtggccatgggcgttagtgacaagagggacatcgagacgtcggaagagc

SEQ ID NO: 41213 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcaactttgagaatgtggtggccatgggcgttagtgacaagagggacatcgagacgtcggaagagc

SEQ ID NO: 41214 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaacgagaatgtggtggccatgggcgttagtgacaagagggacatcgagacgtcggaagagc

SEQ ID NO: 41215 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaacaatgtggtggccatgggcgttagtgacaagagggacatcgagacgtcggaagagc

SEQ ID NO: 41216 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaataacgtggtggccatgggcgttagtgacaagagggacatcgagacgtcggaagagc

SEQ ID NO: 41217 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgaacgtggccatgggcgttagtgacaagagggacatcgagacgtcggaagagc

SEQ ID NO: 41218 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgaacgccatgggcgttagtgacaagagggacatcgagacgtcggaagagc

SEQ ID NO: 41219 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaacatgggcgttagtgacaagagggacatcgagacgtcggaagagc

SEQ ID NO: 41220 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgaacggcgttagtgacaagagggacatcgagacgtcggaagagc

SEQ ID NO: 41221 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcaacgttagtgacaagagggacatcgagacgtcggaagagc

SEQ ID NO: 41222 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttaacagtgacaagagggacatcgagacgtcggaagagc

SEQ ID NO: 41223 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaacgacaagagggacatcgagacgtcggaagagc

SEQ ID NO: 41224 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaacaagagggacatcgagacgtcggaagagc

SEQ ID NO: 41225 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaacagggacatcgagacgtcggaagagc

SEQ ID NO: 41226 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggaacgacatcgagacgtcggaagagc

SEQ ID NO: 41227 - RNA, 299 nt, synthetic construct
  source 1..299: mol_type = other RNA
cgctcttccgcgtctcatgtacgtcatgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41228 - RNA, 299 nt, synthetic construct
  source 1..299: mol_type = other RNA
cgctcttccgcgtctcatgtacgtcgggatggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41229 - RNA, 299 nt, synthetic construct
  source 1..299: mol_type = other RNA
cgctcttccgcgtctcatgtacgtcggggacatggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41230 - RNA, 299 nt, synthetic construct
  source 1..299: mol_type = other RNA
cgctcttccgcgtctcatgtacgtcggggacgtcatgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41231 - RNA, 299 nt, synthetic construct
  source 1..299: mol_type = other RNA
cgctcttccgcgtctcatgtacgtcggggacgtccgcatgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41232 - RNA, 299 nt, synthetic construct
  source 1..299: mol_type = other RNA
cgctcttccgcgtctcatgtacgtcggggacgtccgcagcatggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41233 - RNA, 299 nt, synthetic construct
  source 1..299: mol_type = other RNA
cgctcttccgcgtctcatgtacgtcggggacgtccgcagcgtcatgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41234 - RNA, 299 nt, synthetic construct
  source 1..299: mol_type = other RNA
cgctcttccgcgtctcatgtacgtcggggacgtccgcagcgtcacaatgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41235 - RNA, 299 nt, synthetic construct
  source 1..299: mol_type = other RNA
cgctcttccgcgtctcatgtacgtcggggacgtccgcagcgtcacacagatgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41236 - RNA, 299 nt, synthetic construct
  source 1..299: mol_type = other RNA
cgctcttccgcgtctcatgtacgtcggggacgtccgcagcgtcacacagaagatgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41237 - RNA, 299 nt, synthetic construct
  source 1..299: mol_type = other RNA
cgctcttccgcgtctcatgtacgtcggggacgtccgcagcgtcacacagaagcatatgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41238 - RNA, 299 nt, synthetic construct
  source 1..299: mol_type = other RNA
cgctcttccgcgtctcatgtacgtcggggacgtccgcagcgtcacacagaagcatatcatgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41239 - RNA, 299 nt, synthetic construct
  source 1..299: mol_type = other RNA
cgctcttccgcgtctcatgtacgtcggggacgtccgcagcgtcacacagaagcatatccagatggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41240 - RNA, 299 nt, synthetic construct
  source 1..299: mol_type = other RNA
cgctcttccgcgtctcatgtacgtcggggacgtccgcagcgtcacacagaagcatatccaggagatgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41241 - RNA, 299 nt, synthetic construct
  source 1..299: mol_type = other RNA
cgctcttccgcgtctcatgtacgtcggggacgtccgcagcgtcacacagaagcatatccaggagtggatgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41242 - RNA, 299 nt, synthetic construct
  source 1..299: mol_type = other RNA
cgctcttccgcgtctcatgtacgtcggggacgtccgcagcgtcacacagaagcatatccaggagtggggcatgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41243 - RNA, 299 nt, synthetic construct
  source 1..299: mol_type = other RNA
cgctcttccgcgtctcatgtacgtcggggacgtccgcagcgtcacacagaagcatatccaggagtggggcccaatgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41244 - RNA, 299 nt, synthetic construct
  source 1..299: mol_type = other RNA
cgctcttccgcgtctcatgtacgtcggggacgtccgcagcgtcacacagaagcatatccaggagtggggcccattcatggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41245 - RNA, 299 nt, synthetic construct
  source 1..299: mol_type = other RNA
cgctcttccgcgtctcatgtacgtcggggacgtccgcagcgtcacacagaagcatatccaggagtggggcccattcgacatgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41246 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgatggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41247 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41248 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattatgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41249 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaatgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41250 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcatgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41251 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtatgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41252 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccatgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41253 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcatgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41254 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacatggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41255 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacatgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41256 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcatgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41257 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41258 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattatggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41259 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcatgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41260 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacatgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41261 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctatggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41262 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccatgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41263 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcatgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41264 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagatgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41265 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaatgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41266 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttatgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41267 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatatggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41268 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagatgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41269 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtatgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41270 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactatgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41271 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcatgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41272 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcatgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41273 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcatgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41274 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcatgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41275 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttatggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41276 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagatgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41277 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcatgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41278 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacatgcgcctcctgcatgatgcgcggcccaaggagggagatgatcgccccttcttctggctctttgagaatgtggtggccatgggcgttagtgacaagagggacatcgagacgtcggaagagc

SEQ ID NO: 41279 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcatgctcctgcatgatgcgcggcccaaggagggagatgatcgccccttcttctggctctttgagaatgtggtggccatgggcgttagtgacaagagggacatcgagacgtcggaagagc

SEQ ID NO: 41280 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcatgctgcatgatgcgcggcccaaggagggagatgatcgccccttcttctggctctttgagaatgtggtggccatgggcgttagtgacaagagggacatcgagacgtcggaagagc

SEQ ID NO: 41281 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgatgcatgatgcgcggcccaaggagggagatgatcgccccttcttctggctctttgagaatgtggtggccatgggcgttagtgacaagagggacatcgagacgtcggaagagc

SEQ ID NO: 41282 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatatggatgcgcggcccaaggagggagatgatcgccccttcttctggctctttgagaatgtggtggccatgggcgttagtgacaagagggacatcgagacgtcggaagagc

SEQ ID NO: 41283 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatatggcgcggcccaaggagggagatgatcgccccttcttctggctctttgagaatgtggtggccatgggcgttagtgacaagagggacatcgagacgtcggaagagc

SEQ ID NO: 41284 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgatgcggcccaaggagggagatgatcgccccttcttctggctctttgagaatgtggtggccatgggcgttagtgacaagagggacatcgagacgtcggaagagc

SEQ ID NO: 41285 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggatgcccaaggagggagatgatcgccccttcttctggctctttgagaatgtggtggccatgggcgttagtgacaagagggacatcgagacgtcggaagagc

SEQ ID NO: 41286 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccatgaaggagggagatgatcgccccttcttctggctctttgagaatgtggtggccatgggcgttagtgacaagagggacatcgagacgtcggaagagc

SEQ ID NO: 41287 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagatggagggagatgatcgccccttcttctggctctttgagaatgtggtggccatgggcgttagtgacaagagggacatcgagacgtcggaagagc

SEQ ID NO: 41288 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagatgggagatgatcgccccttcttctggctctttgagaatgtggtggccatgggcgttagtgacaagagggacatcgagacgtcggaagagc

SEQ ID NO: 41289 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaatggatgatcgccccttcttctggctctttgagaatgtggtggccatgggcgttagtgacaagagggacatcgagacgtcggaagagc

SEQ ID NO: 41290 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatatggatcgccccttcttctggctctttgagaatgtggtggccatgggcgttagtgacaagagggacatcgagacgtcggaagagc

SEQ ID NO: 41291 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatatgcgccccttcttctggctctttgagaatgtggtggccatgggcgttagtgacaagagggacatcgagacgtcggaagagc

SEQ ID NO: 41292 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcatgcccttcttctggctctttgagaatgtggtggccatgggcgttagtgacaagagggacatcgagacgtcggaagagc

SEQ ID NO: 41293 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccatgttcttctggctctttgagaatgtggtggccatgggcgttagtgacaagagggacatcgagacgtcggaagagc

SEQ ID NO: 41294 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcatgttctggctctttgagaatgtggtggccatgggcgttagtgacaagagggacatcgagacgtcggaagagc

SEQ ID NO: 41295 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcatgtggctctttgagaatgtggtggccatgggcgttagtgacaagagggacatcgagacgtcggaagagc

SEQ ID NO: 41296 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggatgctctttgagaatgtggtggccatgggcgttagtgacaagagggacatcgagacgtcggaagagc

SEQ ID NO: 41297 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcatgtttgagaatgtggtggccatgggcgttagtgacaagagggacatcgagacgtcggaagagc

SEQ ID NO: 41298 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttatggagaatgtggtggccatgggcgttagtgacaagagggacatcgagacgtcggaagagc

SEQ ID NO: 41299 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagatgaatgtggtggccatgggcgttagtgacaagagggacatcgagacgtcggaagagc

SEQ ID NO: 41300 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatatggtggtggccatgggcgttagtgacaagagggacatcgagacgtcggaagagc

SEQ ID NO: 41301 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgatggtggccatgggcgttagtgacaagagggacatcgagacgtcggaagagc

SEQ ID NO: 41302 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgatggccatgggcgttagtgacaagagggacatcgagacgtcggaagagc

SEQ ID NO: 41303 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgatgggcgttagtgacaagagggacatcgagacgtcggaagagc

SEQ ID NO: 41304 - RNA, 299 nt, synthetic construct; identical to SEQ ID NO: 41303
  source 1..299: mol_type = other RNA

SEQ ID NO: 41305 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcatggttagtgacaagagggacatcgagacgtcggaagagc

SEQ ID NO: 41306 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttatgagtgacaagagggacatcgagacgtcggaagagc

SEQ ID NO: 41307 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtatggacaagagggacatcgagacgtcggaagagc

SEQ ID NO: 41308 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacatgaagagggacatcgagacgtcggaagagc

SEQ ID NO: 41309 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagatgagggacatcgagacgtcggaagagc

SEQ ID NO: 41310 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggatggacatcgagacgtcggaagagc

SEQ ID NO: 41311 - RNA, 299 nt, synthetic construct
  source 1..299: mol_type = other RNA
cgctcttccgcgtctcatgtacgtcatcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41312 - RNA, 299 nt, synthetic construct
  source 1..299: mol_type = other RNA
cgctcttccgcgtctcatgtacgtcgggatcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41313 - RNA, 299 nt, synthetic construct
  source 1..299: mol_type = other RNA
cgctcttccgcgtctcatgtacgtcggggacatcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41314 - RNA, 299 nt, synthetic construct
  source 1..299: mol_type = other RNA
cgctcttccgcgtctcatgtacgtcggggacgtcatccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41315 - RNA, 299 nt, synthetic construct
  source 1..299: mol_type = other RNA
cgctcttccgcgtctcatgtacgtcggggacgtccgcatcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41316 - RNA, 299 nt, synthetic construct
  source 1..299: mol_type = other RNA
cgctcttccgcgtctcatgtacgtcggggacgtccgcagcatcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41317 - RNA, 299 nt, synthetic construct
  source 1..299: mol_type = other RNA
cgctcttccgcgtctcatgtacgtcggggacgtccgcagcgtcatcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41318 - RNA, 299 nt, synthetic construct
  source 1..299: mol_type = other RNA
cgctcttccgcgtctcatgtacgtcggggacgtccgcagcgtcacaatccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41319 - RNA, 299 nt, synthetic construct
  source 1..299: mol_type = other RNA
cgctcttccgcgtctcatgtacgtcggggacgtccgcagcgtcacacagatcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41320 - RNA, 299 nt, synthetic construct
  source 1..299: mol_type = other RNA
cgctcttccgcgtctcatgtacgtcggggacgtccgcagcgtcacacagaagatccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41321 - RNA, 299 nt, synthetic construct
  source 1..299: mol_type = other RNA
cgctcttccgcgtctcatgtacgtcggggacgtccgcagcgtcacacagaagcatatcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41322 - RNA, 299 nt, synthetic construct; identical to SEQ ID NO: 41321
  source 1..299: mol_type = other RNA

SEQ ID NO: 41323 - RNA, 299 nt, synthetic construct
  source 1..299: mol_type = other RNA
cgctcttccgcgtctcatgtacgtcggggacgtccgcagcgtcacacagaagcatatccagatcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41324 - RNA, 299 nt, synthetic construct
  source 1..299: mol_type = other RNA
cgctcttccgcgtctcatgtacgtcggggacgtccgcagcgtcacacagaagcatatccaggagatctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41325 - RNA, 299 nt, synthetic construct
  source 1..299: mol_type = other RNA
cgctcttccgcgtctcatgtacgtcggggacgtccgcagcgtcacacagaagcatatccaggagtggatcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41326 - RNA, 299 nt, synthetic construct
  source 1..299: mol_type = other RNA
cgctcttccgcgtctcatgtacgtcggggacgtccgcagcgtcacacagaagcatatccaggagtggggcatcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41327 - RNA, 299 nt, synthetic construct
  source 1..299: mol_type = other RNA
cgctcttccgcgtctcatgtacgtcggggacgtccgcagcgtcacacagaagcatatccaggagtggggcccaatcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41328 - RNA, 299 nt, synthetic construct
  source 1..299: mol_type = other RNA
cgctcttccgcgtctcatgtacgtcggggacgtccgcagcgtcacacagaagcatatccaggagtggggcccattcatcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41329 - RNA, 299 nt, synthetic construct
  source 1..299: mol_type = other RNA
cgctcttccgcgtctcatgtacgtcggggacgtccgcagcgtcacacagaagcatatccaggagtggggcccattcgacatcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41330 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgatcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41331 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41332 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattatcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41333 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaatcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41334 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcatcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41335 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtatcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41336 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccatctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41337 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcatcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41338 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacatcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41339 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacatcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41340 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcatctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41341 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41342 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattatcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41343 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcatcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41344 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacatccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41345 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctatcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41346 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccatccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41347 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcatcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41348 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagatcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41349 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaatcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41350 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttatctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41351 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatatcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41352 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagatcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41353 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtatcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41354 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactatcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41355 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcatccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41356 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcatcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41357 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcatcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41358 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcatctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41359 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttatcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41360 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagatcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41361 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcatctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41362 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacatccgcctcctgcatgatgcgcggcccaaggagggagatgatcgccccttcttctggctctttgagaatgtggtggccatgggcgttagtgacaagagggacatcgagacgtcggaagagc

SEQ ID NO: 41363 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcatcctcctgcatgatgcgcggcccaaggagggagatgatcgccccttcttctggctctttgagaatgtggtggccatgggcgttagtgacaagagggacatcgagacgtcggaagagc

SEQ ID NO: 41364 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcatcctgcatgatgcgcggcccaaggagggagatgatcgccccttcttctggctctttgagaatgtggtggccatgggcgttagtgacaagagggacatcgagacgtcggaagagc

SEQ ID NO: 41365 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgatccatgatgcgcggcccaaggagggagatgatcgccccttcttctggctctttgagaatgtggtggccatgggcgttagtgacaagagggacatcgagacgtcggaagagc

SEQ ID NO: 41366 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatatcgatgcgcggcccaaggagggagatgatcgccccttcttctggctctttgagaatgtggtggccatgggcgttagtgacaagagggacatcgagacgtcggaagagc

SEQ ID NO: 41367 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatatcgcgcggcccaaggagggagatgatcgccccttcttctggctctttgagaatgtggtggccatgggcgttagtgacaagagggacatcgagacgtcggaagagc

SEQ ID NO: 41368 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgatccggcccaaggagggagatgatcgccccttcttctggctctttgagaatgtggtggccatgggcgttagtgacaagagggacatcgagacgtcggaagagc

SEQ ID NO: 41369 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggatccccaaggagggagatgatcgccccttcttctggctctttgagaatgtggtggccatgggcgttagtgacaagagggacatcgagacgtcggaagagc

SEQ ID NO: 41370 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccatcaaggagggagatgatcgccccttcttctggctctttgagaatgtggtggccatgggcgttagtgacaagagggacatcgagacgtcggaagagc

SEQ ID NO: 41371 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagatcgagggagatgatcgccccttcttctggctctttgagaatgtggtggccatgggcgttagtgacaagagggacatcgagacgtcggaagagc

SEQ ID NO: 41372 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagatcggagatgatcgccccttcttctggctctttgagaatgtggtggccatgggcgttagtgacaagagggacatcgagacgtcggaagagc

SEQ ID NO: 41373 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaatcgatgatcgccccttcttctggctctttgagaatgtggtggccatgggcgttagtgacaagagggacatcgagacgtcggaagagc

SEQ ID NO: 41374 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatatcgatcgccccttcttctggctctttgagaatgtggtggccatgggcgttagtgacaagagggacatcgagacgtcggaagagc

SEQ ID NO: 41375 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatatccgccccttcttctggctctttgagaatgtggtggccatgggcgttagtgacaagagggacatcgagacgtcggaagagc

SEQ ID NO: 41376 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcatccccttcttctggctctttgagaatgtggtggccatgggcgttagtgacaagagggacatcgagacgtcggaagagc

SEQ ID NO: 41377 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccatcttcttctggctctttgagaatgtggtggccatgggcgttagtgacaagagggacatcgagacgtcggaagagc

SEQ ID NO: 41378 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcatcttctggctctttgagaatgtggtggccatgggcgttagtgacaagagggacatcgagacgtcggaagagc

SEQ ID NO: 41379 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcatctggctctttgagaatgtggtggccatgggcgttagtgacaagagggacatcgagacgtcggaagagc

SEQ ID NO: 41380 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggatcctctttgagaatgtggtggccatgggcgttagtgacaagagggacatcgagacgtcggaagagc

SEQ ID NO: 41381 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcatctttgagaatgtggtggccatgggcgttagtgacaagagggacatcgagacgtcggaagagc

SEQ ID NO: 41382 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttatcgagaatgtggtggccatgggcgttagtgacaagagggacatcgagacgtcggaagagc

SEQ ID NO: 41383 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagatcaatgtggtggccatgggcgttagtgacaagagggacatcgagacgtcggaagagc

SEQ ID NO: 41384 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatatcgtggtggccatgggcgttagtgacaagagggacatcgagacgtcggaagagc

SEQ ID NO: 41385 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgatcgtggccatgggcgttagtgacaagagggacatcgagacgtcggaagagc

SEQ ID NO: 41386 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgatcgccatgggcgttagtgacaagagggacatcgagacgtcggaagagc

SEQ ID NO: 41387 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatcatgggcgttagtgacaagagggacatcgagacgtcggaagagc

SEQ ID NO: 41388 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgatcggcgttagtgacaagagggacatcgagacgtcggaagagc

SEQ ID NO: 41389 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcatcgttagtgacaagagggacatcgagacgtcggaagagc

SEQ ID NO: 41390 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttatcagtgacaagagggacatcgagacgtcggaagagc

SEQ ID NO: 41391 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtatcgacaagagggacatcgagacgtcggaagagc

SEQ ID NO: 41392 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacatcaagagggacatcgagacgtcggaagagc

SEQ ID NO: 41393 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagatcagggacatcgagacgtcggaagagc

SEQ ID NO: 41394 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggatcgacatcgagacgtcggaagagc

SEQ ID NO: 41395 - RNA, 299 nt, synthetic construct
  source 1..299: mol_type = other RNA
cgctcttccgcgtctcatgtacgtcaggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41396 - RNA, 299 nt, synthetic construct
  source 1..299: mol_type = other RNA
cgctcttccgcgtctcatgtacgtcgggagggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41397 - RNA, 299 nt, synthetic construct
  source 1..299: mol_type = other RNA
cgctcttccgcgtctcatgtacgtcggggacagggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41398 - RNA, 299 nt, synthetic construct
  source 1..299: mol_type = other RNA
cgctcttccgcgtctcatgtacgtcggggacgtcaggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41399 - RNA, 299 nt, synthetic construct
  source 1..299: mol_type = other RNA
cgctcttccgcgtctcatgtacgtcggggacgtccgcaggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41400 - RNA, 299 nt, synthetic construct
  source 1..299: mol_type = other RNA
cgctcttccgcgtctcatgtacgtcggggacgtccgcagcagggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41401 - RNA, 299 nt, synthetic construct
  source 1..299: mol_type = other RNA
cgctcttccgcgtctcatgtacgtcggggacgtccgcagcgtcaggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41402 - RNA, 299 nt, synthetic construct
  source 1..299: mol_type = other RNA
cgctcttccgcgtctcatgtacgtcggggacgtccgcagcgtcacaaggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41403 - RNA, 299 nt, synthetic construct
  source 1..299: mol_type = other RNA
cgctcttccgcgtctcatgtacgtcggggacgtccgcagcgtcacacagaggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41404 - RNA, 299 nt, synthetic construct
  source 1..299: mol_type = other RNA
cgctcttccgcgtctcatgtacgtcggggacgtccgcagcgtcacacagaagaggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41405 - RNA, 299 nt, synthetic construct
  source 1..299: mol_type = other RNA
cgctcttccgcgtctcatgtacgtcggggacgtccgcagcgtcacacagaagcataggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41406 - RNA, 299 nt, synthetic construct
  source 1..299: mol_type = other RNA
cgctcttccgcgtctcatgtacgtcggggacgtccgcagcgtcacacagaagcatatcaggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41407 - RNA, 299 nt, synthetic construct
  source 1..299: mol_type = other RNA
cgctcttccgcgtctcatgtacgtcggggacgtccgcagcgtcacacagaagcatatccagagggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41408 - RNA, 299 nt, synthetic construct
  source 1..299: mol_type = other RNA
cgctcttccgcgtctcatgtacgtcggggacgtccgcagcgtcacacagaagcatatccaggagaggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41409 - RNA, 299 nt, synthetic construct
  source 1..299: mol_type = other RNA
cgctcttccgcgtctcatgtacgtcggggacgtccgcagcgtcacacagaagcatatccaggagtggaggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41410 - RNA, 299 nt, synthetic construct
  source 1..299: mol_type = other RNA
cgctcttccgcgtctcatgtacgtcggggacgtccgcagcgtcacacagaagcatatccaggagtggggcaggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41411 - RNA, 299 nt, synthetic construct
  source 1..299: mol_type = other RNA
cgctcttccgcgtctcatgtacgtcggggacgtccgcagcgtcacacagaagcatatccaggagtggggcccaaggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41412 - RNA, 299 nt, synthetic construct
  source 1..299: mol_type = other RNA
cgctcttccgcgtctcatgtacgtcggggacgtccgcagcgtcacacagaagcatatccaggagtggggcccattcagggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41413 - RNA, 299 nt, synthetic construct
  source 1..299: mol_type = other RNA
cgctcttccgcgtctcatgtacgtcggggacgtccgcagcgtcacacagaagcatatccaggagtggggcccattcgacaggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41414 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgagggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41415 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgaggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41416 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattaggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41417 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaaggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41418 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcaggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41419 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtaggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41420 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccaggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41421 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41422 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacagggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41423 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacaggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41424 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcaggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41425 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccaggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41426 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattagggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41427 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41428 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacaggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41429 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctagggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41430 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41431 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41432 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41433 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaaggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41434 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttaggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41435 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatagggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41436 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41437 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41438 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactaggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41439 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcaggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41440 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41441 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcaggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41442 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcaggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41443 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttagggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41444 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagaggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41445 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcaggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41446 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacaggcgcctcctgcatgatgcgcggcccaaggagggagatgatcgccccttcttctggctctttgagaatgtggtggccatgggcgttagtgacaagagggacatcgagacgtcggaagagc

SEQ ID NO: 41447 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaggctcctgcatgatgcgcggcccaaggagggagatgatcgccccttcttctggctctttgagaatgtggtggccatgggcgttagtgacaagagggacatcgagacgtcggaagagc

SEQ ID NO: 41448 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcaggctgcatgatgcgcggcccaaggagggagatgatcgccccttcttctggctctttgagaatgtggtggccatgggcgttagtgacaagagggacatcgagacgtcggaagagc

SEQ ID NO: 41449 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgaggcatgatgcgcggcccaaggagggagatgatcgccccttcttctggctctttgagaatgtggtggccatgggcgttagtgacaagagggacatcgagacgtcggaagagc

SEQ ID NO: 41450 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatagggatgcgcggcccaaggagggagatgatcgccccttcttctggctctttgagaatgtggtggccatgggcgttagtgacaagagggacatcgagacgtcggaagagc

SEQ ID NO: 41451 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatagggcgcggcccaaggagggagatgatcgccccttcttctggctctttgagaatgtggtggccatgggcgttagtgacaagagggacatcgagacgtcggaagagc

SEQ ID NO: 41452 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgaggcggcccaaggagggagatgatcgccccttcttctggctctttgagaatgtggtggccatgggcgttagtgacaagagggacatcgagacgtcggaagagc

SEQ ID NO: 41453 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaggcccaaggagggagatgatcgccccttcttctggctctttgagaatgtggtggccatgggcgttagtgacaagagggacatcgagacgtcggaagagc

SEQ ID NO: 41454 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaggaaggagggagatgatcgccccttcttctggctctttgagaatgtggtggccatgggcgttagtgacaagagggacatcgagacgtcggaagagc

SEQ ID NO: 41455 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagagggagggagatgatcgccccttcttctggctctttgagaatgtggtggccatgggcgttagtgacaagagggacatcgagacgtcggaagagc

SEQ ID NO: 41456 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagaggggagatgatcgccccttcttctggctctttgagaatgtggtggccatgggcgttagtgacaagagggacatcgagacgtcggaagagc

SEQ ID NO: 41457 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaagggatgatcgccccttcttctggctctttgagaatgtggtggccatgggcgttagtgacaagagggacatcgagacgtcggaagagc

SEQ ID NO: 41458 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatagggatcgccccttcttctggctctttgagaatgtggtggccatgggcgttagtgacaagagggacatcgagacgtcggaagagc

SEQ ID NO: 41459 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgataggcgccccttcttctggctctttgagaatgtggtggccatgggcgttagtgacaagagggacatcgagacgtcggaagagc

SEQ ID NO: 41460 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcaggcccttcttctggctctttgagaatgtggtggccatgggcgttagtgacaagagggacatcgagacgtcggaagagc

SEQ ID NO: 41461 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaggttcttctggctctttgagaatgtggtggccatgggcgttagtgacaagagggacatcgagacgtcggaagagc

SEQ ID NO: 41462 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcaggttctggctctttgagaatgtggtggccatgggcgttagtgacaagagggacatcgagacgtcggaagagc

SEQ ID NO: 41463 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcaggtggctctttgagaatgtggtggccatgggcgttagtgacaagagggacatcgagacgtcggaagagc

SEQ ID NO: 41464 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggaggctctttgagaatgtggtggccatgggcgttagtgacaagagggacatcgagacgtcggaagagc

SEQ ID NO: 41465 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcaggtttgagaatgtggtggccatgggcgttagtgacaagagggacatcgagacgtcggaagagc

SEQ ID NO: 41466 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttagggagaatgtggtggccatgggcgttagtgacaagagggacatcgagacgtcggaagagc

SEQ ID NO: 41467 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaggaatgtggtggccatgggcgttagtgacaagagggacatcgagacgtcggaagagc

SEQ ID NO: 41468 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatagggtggtggccatgggcgttagtgacaagagggacatcgagacgtcggaagagc

SEQ ID NO: 41469 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgagggtggccatgggcgttagtgacaagagggacatcgagacgtcggaagagc

SEQ ID NO: 41470 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgagggccatgggcgttagtgacaagagggacatcgagacgtcggaagagc

SEQ ID NO: 41471 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaggatgggcgttagtgacaagagggacatcgagacgtcggaagagc

SEQ ID NO: 41472 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgaggggcgttagtgacaagagggacatcgagacgtcggaagagc

SEQ ID NO: 41473 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcagggttagtgacaagagggacatcgagacgtcggaagagc

SEQ ID NO: 41474 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttaggagtgacaagagggacatcgagacgtcggaagagc

SEQ ID NO: 41475 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtagggacaagagggacatcgagacgtcggaagagc

SEQ ID NO: 41476 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaggaagagggacatcgagacgtcggaagagc

SEQ ID NO: 41477 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggagggacatcgagacgtcggaagagc

SEQ ID NO: 41478 - RNA, 299 nt, synthetic construct; identical to SEQ ID NO: 41477
  source 1..299: mol_type = other RNA

SEQ ID NO: 41479 - RNA, 299 nt, synthetic construct
  source 1..299: mol_type = other RNA
cgctcttccgcgtctcatgtacgtcagcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41480 - RNA, 299 nt, synthetic construct
  source 1..299: mol_type = other RNA
cgctcttccgcgtctcatgtacgtcgggagcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41481 - RNA, 299 nt, synthetic construct
  source 1..299: mol_type = other RNA
cgctcttccgcgtctcatgtacgtcggggacagcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41482 - RNA, 299 nt, synthetic construct
  source 1..299: mol_type = other RNA
cgctcttccgcgtctcatgtacgtcggggacgtcagccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41483 - RNA, 299 nt, synthetic construct
  source 1..299: mol_type = other RNA
cgctcttccgcgtctcatgtacgtcggggacgtccgcagcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41484 - RNA, 299 nt, synthetic construct; identical to SEQ ID NO: 41483
  source 1..299: mol_type = other RNA

SEQ ID NO: 41485 - RNA, 299 nt, synthetic construct
  source 1..299: mol_type = other RNA
cgctcttccgcgtctcatgtacgtcggggacgtccgcagcgtcagcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41486 - RNA, 299 nt, synthetic construct
  source 1..299: mol_type = other RNA
cgctcttccgcgtctcatgtacgtcggggacgtccgcagcgtcacaagccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41487 - RNA, 299 nt, synthetic construct
  source 1..299: mol_type = other RNA
cgctcttccgcgtctcatgtacgtcggggacgtccgcagcgtcacacagagcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41488 - RNA, 299 nt, synthetic construct
  source 1..299: mol_type = other RNA
cgctcttccgcgtctcatgtacgtcggggacgtccgcagcgtcacacagaagagccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41489 - RNA, 299 nt, synthetic construct
  source 1..299: mol_type = other RNA
cgctcttccgcgtctcatgtacgtcggggacgtccgcagcgtcacacagaagcatagcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41490 - RNA, 299 nt, synthetic construct
  source 1..299: mol_type = other RNA
cgctcttccgcgtctcatgtacgtcggggacgtccgcagcgtcacacagaagcatatcagccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41491 - RNA, 299 nt, synthetic construct
  source 1..299: mol_type = other RNA
cgctcttccgcgtctcatgtacgtcggggacgtccgcagcgtcacacagaagcatatccagagcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41492 - RNA, 299 nt, synthetic construct
  source 1..299: mol_type = other RNA
cgctcttccgcgtctcatgtacgtcggggacgtccgcagcgtcacacagaagcatatccaggagagctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41493 - RNA, 299 nt, synthetic construct
  source 1..299: mol_type = other RNA
cgctcttccgcgtctcatgtacgtcggggacgtccgcagcgtcacacagaagcatatccaggagtggagcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41494 - RNA, 299 nt, synthetic construct
  source 1..299: mol_type = other RNA
cgctcttccgcgtctcatgtacgtcggggacgtccgcagcgtcacacagaagcatatccaggagtggggcagcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41495 - RNA, 299 nt, synthetic construct
  source 1..299: mol_type = other RNA
cgctcttccgcgtctcatgtacgtcggggacgtccgcagcgtcacacagaagcatatccaggagtggggcccaagcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41496 - RNA, 299 nt, synthetic construct
  source 1..299: mol_type = other RNA
cgctcttccgcgtctcatgtacgtcggggacgtccgcagcgtcacacagaagcatatccaggagtggggcccattcagcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41497 - RNA, 299 nt, synthetic construct
  source 1..299: mol_type = other RNA
cgctcttccgcgtctcatgtacgtcggggacgtccgcagcgtcacacagaagcatatccaggagtggggcccattcgacagcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41498 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgagcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41499 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgagcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41500 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattagcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41501 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaagcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41502 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41503 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtagcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41504 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccagctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41505 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcagcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41506 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacagcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41507 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacagcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41508 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcagctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41509 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccagcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41510 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattagcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41511 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcagcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41512 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacagccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41513 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctagcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41514 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccagccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41515 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcagcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41516 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagagcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41517 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaagcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41518 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttagctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41519 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatagcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41520 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagagcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41521 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtagcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41522 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactagcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41523 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcagccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41524 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcagcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41525 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcagcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41526 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcagctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41527 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttagcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41528 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagagcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41529 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcagctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41530 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacagccgcctcctgcatgatgcgcggcccaaggagggagatgatcgccccttcttctggctctttgagaatgtggtggccatgggcgttagtgacaagagggacatcgagacgtcggaagagc

SEQ ID NO: 41531 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcagcctcctgcatgatgcgcggcccaaggagggagatgatcgccccttcttctggctctttgagaatgtggtggccatgggcgttagtgacaagagggacatcgagacgtcggaagagc

SEQ ID NO: 41532 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcagcctgcatgatgcgcggcccaaggagggagatgatcgccccttcttctggctctttgagaatgtggtggccatgggcgttagtgacaagagggacatcgagacgtcggaagagc

SEQ ID NO: 41533 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgagccatgatgcgcggcccaaggagggagatgatcgccccttcttctggctctttgagaatgtggtggccatgggcgttagtgacaagagggacatcgagacgtcggaagagc

SEQ ID NO: 41534 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatagcgatgcgcggcccaaggagggagatgatcgccccttcttctggctctttgagaatgtggtggccatgggcgttagtgacaagagggacatcgagacgtcggaagagc

SEQ ID NO: 41535 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatagcgcgcggcccaaggagggagatgatcgccccttcttctggctctttgagaatgtggtggccatgggcgttagtgacaagagggacatcgagacgtcggaagagc

SEQ ID NO: 41536 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgagccggcccaaggagggagatgatcgccccttcttctggctctttgagaatgtggtggccatgggcgttagtgacaagagggacatcgagacgtcggaagagc

SEQ ID NO: 41537 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggagccccaaggagggagatgatcgccccttcttctggctctttgagaatgtggtggccatgggcgttagtgacaagagggacatcgagacgtcggaagagc

SEQ ID NO: 41538 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccagcaaggagggagatgatcgccccttcttctggctctttgagaatgtggtggccatgggcgttagtgacaagagggacatcgagacgtcggaagagc

SEQ ID NO: 41539 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagagcgagggagatgatcgccccttcttctggctctttgagaatgtggtggccatgggcgttagtgacaagagggacatcgagacgtcggaagagc

SEQ ID NO: 41540 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagagcggagatgatcgccccttcttctggctctttgagaatgtggtggccatgggcgttagtgacaagagggacatcgagacgtcggaagagc

SEQ ID NO: 41541 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaagcgatgatcgccccttcttctggctctttgagaatgtggtggccatgggcgttagtgacaagagggacatcgagacgtcggaagagc

SEQ ID NO: 41542 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatagcgatcgccccttcttctggctctttgagaatgtggtggccatgggcgttagtgacaagagggacatcgagacgtcggaagagc

SEQ ID NO: 41543 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatagccgccccttcttctggctctttgagaatgtggtggccatgggcgttagtgacaagagggacatcgagacgtcggaagagc

SEQ ID NO: 41544 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcagccccttcttctggctctttgagaatgtggtggccatgggcgttagtgacaagagggacatcgagacgtcggaagagc

SEQ ID NO: 41545 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccagcttcttctggctctttgagaatgtggtggccatgggcgttagtgacaagagggacatcgagacgtcggaagagc

SEQ ID NO: 41546 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcagcttctggctctttgagaatgtggtggccatgggcgttagtgacaagagggacatcgagacgtcggaagagc

SEQ ID NO: 41547 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcagctggctctttgagaatgtggtggccatgggcgttagtgacaagagggacatcgagacgtcggaagagc

SEQ ID NO: 41548 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggagcctctttgagaatgtggtggccatgggcgttagtgacaagagggacatcgagacgtcggaagagc

SEQ ID NO: 41549 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcagctttgagaatgtggtggccatgggcgttagtgacaagagggacatcgagacgtcggaagagc

SEQ ID NO: 41550 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttagcgagaatgtggtggccatgggcgttagtgacaagagggacatcgagacgtcggaagagc

SEQ ID NO: 41551 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagagcaatgtggtggccatgggcgttagtgacaagagggacatcgagacgtcggaagagc

SEQ ID NO: 41552 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatagcgtggtggccatgggcgttagtgacaagagggacatcgagacgtcggaagagc

SEQ ID NO: 41553 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgagcgtggccatgggcgttagtgacaagagggacatcgagacgtcggaagagc

SEQ ID NO: 41554 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgagcgccatgggcgttagtgacaagagggacatcgagacgtcggaagagc

SEQ ID NO: 41555 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccagcatgggcgttagtgacaagagggacatcgagacgtcggaagagc

SEQ ID NO: 41556 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgagcggcgttagtgacaagagggacatcgagacgtcggaagagc

SEQ ID NO: 41557 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcagcgttagtgacaagagggacatcgagacgtcggaagagc

SEQ ID NO: 41558 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagcagtgacaagagggacatcgagacgtcggaagagc

SEQ ID NO: 41559 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtagcgacaagagggacatcgagacgtcggaagagc

SEQ ID NO: 41560 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacagcaagagggacatcgagacgtcggaagagc

SEQ ID NO: 41561 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagcagggacatcgagacgtcggaagagc

SEQ ID NO: 41562 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggagcgacatcgagacgtcggaagagc

SEQ ID NO: 41563 - RNA, 299 nt, synthetic construct
  source 1..299: mol_type = other RNA
cgctcttccgcgtctcatgtacgtcacgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41564 - RNA, 299 nt, synthetic construct
  source 1..299: mol_type = other RNA
cgctcttccgcgtctcatgtacgtcgggacggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41565 - RNA, 299 nt, synthetic construct
  source 1..299: mol_type = other RNA
cgctcttccgcgtctcatgtacgtcggggacacggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41566 - RNA, 299 nt, synthetic construct
  source 1..299: mol_type = other RNA
cgctcttccgcgtctcatgtacgtcggggacgtcacgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41567 - RNA, 299 nt, synthetic construct
  source 1..299: mol_type = other RNA
cgctcttccgcgtctcatgtacgtcggggacgtccgcacgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41568 - RNA, 299 nt, synthetic construct
  source 1..299: mol_type = other RNA
cgctcttccgcgtctcatgtacgtcggggacgtccgcagcacggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41569 - RNA, 299 nt, synthetic construct
  source 1..299: mol_type = other RNA
cgctcttccgcgtctcatgtacgtcggggacgtccgcagcgtcacgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41570 - RNA, 299 nt, synthetic construct
  source 1..299: mol_type = other RNA
cgctcttccgcgtctcatgtacgtcggggacgtccgcagcgtcacaacgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41571 - RNA, 299 nt, synthetic construct
  source 1..299: mol_type = other RNA
cgctcttccgcgtctcatgtacgtcggggacgtccgcagcgtcacacagacgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41572 - RNA, 299 nt, synthetic construct
  source 1..299: mol_type = other RNA
cgctcttccgcgtctcatgtacgtcggggacgtccgcagcgtcacacagaagacgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41573 - RNA, 299 nt, synthetic construct
  source 1..299: mol_type = other RNA
cgctcttccgcgtctcatgtacgtcggggacgtccgcagcgtcacacagaagcatacgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41574 - RNA, 299 nt, synthetic construct
  source 1..299: mol_type = other RNA
cgctcttccgcgtctcatgtacgtcggggacgtccgcagcgtcacacagaagcatatcacgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41575 - RNA, 299 nt, synthetic construct
  source 1..299: mol_type = other RNA
cgctcttccgcgtctcatgtacgtcggggacgtccgcagcgtcacacagaagcatatccagacggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41576 - RNA, 299 nt, synthetic construct
  source 1..299: mol_type = other RNA
cgctcttccgcgtctcatgtacgtcggggacgtccgcagcgtcacacagaagcatatccaggagacgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41577 - RNA, 299 nt, synthetic construct
  source 1..299: mol_type = other RNA
cgctcttccgcgtctcatgtacgtcggggacgtccgcagcgtcacacagaagcatatccaggagtggacgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41578 - RNA, 299 nt, synthetic construct
  source 1..299: mol_type = other RNA
cgctcttccgcgtctcatgtacgtcggggacgtccgcagcgtcacacagaagcatatccaggagtggggcacgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41579 - RNA, 299 nt, synthetic construct
  source 1..299: mol_type = other RNA
cgctcttccgcgtctcatgtacgtcggggacgtccgcagcgtcacacagaagcatatccaggagtggggcccaacgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41580 - RNA, 299 nt, synthetic construct
  source 1..299: mol_type = other RNA
cgctcttccgcgtctcatgtacgtcggggacgtccgcagcgtcacacagaagcatatccaggagtggggcccattcacggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41581 - RNA, 299 nt, synthetic construct
  source 1..299: mol_type = other RNA
cgctcttccgcgtctcatgtacgtcggggacgtccgcagcgtcacacagaagcatatccaggagtggggcccattcgacacgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41582 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgacggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41583 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgacgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41584 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattacgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41585 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaacgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41586 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcacgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41587 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtacgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41588 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccacgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41589 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcacgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41590 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacacggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41591 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacacgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41592 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcacgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41593 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccacgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41594 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattacggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41595 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcacgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41596 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacacgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41597 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctacggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41598 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccacgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41599 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcacgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41600 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagacgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41601 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaacgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41602 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttacgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41603 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatacggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41604 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagacgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41605 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41606 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactacgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41607 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcacgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41608 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcacgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41609 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcacgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41610 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcacgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41611 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttacggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41612 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagacgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41613 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcacgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41614 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacacgcgcctcctgcatgatgcgcggcccaaggagggagatgatcgccccttcttctggctctttgagaatgtggtggccatgggcgttagtgacaagagggacatcgagacgtcggaagagc

SEQ ID NO: 41615 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcacgctcctgcatgatgcgcggcccaaggagggagatgatcgccccttcttctggctctttgagaatgtggtggccatgggcgttagtgacaagagggacatcgagacgtcggaagagc

SEQ ID NO: 41616 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcacgctgcatgatgcgcggcccaaggagggagatgatcgccccttcttctggctctttgagaatgtggtggccatgggcgttagtgacaagagggacatcgagacgtcggaagagc

SEQ ID NO: 41617 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgacgcatgatgcgcggcccaaggagggagatgatcgccccttcttctggctctttgagaatgtggtggccatgggcgttagtgacaagagggacatcgagacgtcggaagagc

SEQ ID NO: 41618 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatacggatgcgcggcccaaggagggagatgatcgccccttcttctggctctttgagaatgtggtggccatgggcgttagtgacaagagggacatcgagacgtcggaagagc

SEQ ID NO: 41619 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatacggcgcggcccaaggagggagatgatcgccccttcttctggctctttgagaatgtggtggccatgggcgttagtgacaagagggacatcgagacgtcggaagagc

SEQ ID NO: 41620 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgacgcggcccaaggagggagatgatcgccccttcttctggctctttgagaatgtggtggccatgggcgttagtgacaagagggacatcgagacgtcggaagagc

SEQ ID NO: 41621 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggacgcccaaggagggagatgatcgccccttcttctggctctttgagaatgtggtggccatgggcgttagtgacaagagggacatcgagacgtcggaagagc

SEQ ID NO: 41622 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccacgaaggagggagatgatcgccccttcttctggctctttgagaatgtggtggccatgggcgttagtgacaagagggacatcgagacgtcggaagagc

SEQ ID NO: 41623 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagacggagggagatgatcgccccttcttctggctctttgagaatgtggtggccatgggcgttagtgacaagagggacatcgagacgtcggaagagc

SEQ ID NO: 41624 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagacgggagatgatcgccccttcttctggctctttgagaatgtggtggccatgggcgttagtgacaagagggacatcgagacgtcggaagagc

SEQ ID NO: 41625 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaacggatgatcgccccttcttctggctctttgagaatgtggtggccatgggcgttagtgacaagagggacatcgagacgtcggaagagc

SEQ ID NO: 41626 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatacggatcgccccttcttctggctctttgagaatgtggtggccatgggcgttagtgacaagagggacatcgagacgtcggaagagc

SEQ ID NO: 41627 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatacgcgccccttcttctggctctttgagaatgtggtggccatgggcgttagtgacaagagggacatcgagacgtcggaagagc

SEQ ID NO: 41628 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcacgcccttcttctggctctttgagaatgtggtggccatgggcgttagtgacaagagggacatcgagacgtcggaagagc

SEQ ID NO: 41629 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccacgttcttctggctctttgagaatgtggtggccatgggcgttagtgacaagagggacatcgagacgtcggaagagc

SEQ ID NO: 41630 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcacgttctggctctttgagaatgtggtggccatgggcgttagtgacaagagggacatcgagacgtcggaagagc

SEQ ID NO: 41631 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcacgtggctctttgagaatgtggtggccatgggcgttagtgacaagagggacatcgagacgtcggaagagc

SEQ ID NO: 41632 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggacgctctttgagaatgtggtggccatgggcgttagtgacaagagggacatcgagacgtcggaagagc

SEQ ID NO: 41633 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcacgtttgagaatgtggtggccatgggcgttagtgacaagagggacatcgagacgtcggaagagc

SEQ ID NO: 41634 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttacggagaatgtggtggccatgggcgttagtgacaagagggacatcgagacgtcggaagagc

SEQ ID NO: 41635 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagacgaatgtggtggccatgggcgttagtgacaagagggacatcgagacgtcggaagagc

SEQ ID NO: 41636 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatacggtggtggccatgggcgttagtgacaagagggacatcgagacgtcggaagagc

SEQ ID NO: 41637 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgacggtggccatgggcgttagtgacaagagggacatcgagacgtcggaagagc

SEQ ID NO: 41638 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgacggccatgggcgttagtgacaagagggacatcgagacgtcggaagagc

SEQ ID NO: 41639 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccacgatgggcgttagtgacaagagggacatcgagacgtcggaagagc

SEQ ID NO: 41640 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgacgggcgttagtgacaagagggacatcgagacgtcggaagagc

SEQ ID NO: 41641 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcacggttagtgacaagagggacatcgagacgtcggaagagc

SEQ ID NO: 41642 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttacgagtgacaagagggacatcgagacgtcggaagagc

SEQ ID NO: 41643 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtacggacaagagggacatcgagacgtcggaagagc

SEQ ID NO: 41644 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacacgaagagggacatcgagacgtcggaagagc

SEQ ID NO: 41645 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagacgagggacatcgagacgtcggaagagc

SEQ ID NO: 41646 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggacggacatcgagacgtcggaagagc

SEQ ID NO: 41647 - RNA, 299 nt, synthetic construct
  source 1..299: mol_type = other RNA
cgctcttccgcgtctcatgtacgtcaccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41648 - RNA, 299 nt, synthetic construct
  source 1..299: mol_type = other RNA
cgctcttccgcgtctcatgtacgtcgggaccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41649 - RNA, 299 nt, synthetic construct
  source 1..299: mol_type = other RNA
cgctcttccgcgtctcatgtacgtcggggacaccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41650 - RNA, 299 nt, synthetic construct
  source 1..299: mol_type = other RNA
cgctcttccgcgtctcatgtacgtcggggacgtcacccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41651 - RNA, 299 nt, synthetic construct
  source 1..299: mol_type = other RNA
cgctcttccgcgtctcatgtacgtcggggacgtccgcaccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41652 - RNA, 299 nt, synthetic construct
  source 1..299: mol_type = other RNA
cgctcttccgcgtctcatgtacgtcggggacgtccgcagcaccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41653 - RNA, 299 nt, synthetic construct
  source 1..299: mol_type = other RNA
cgctcttccgcgtctcatgtacgtcggggacgtccgcagcgtcaccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41654 - RNA, 299 nt, synthetic construct
  source 1..299: mol_type = other RNA
cgctcttccgcgtctcatgtacgtcggggacgtccgcagcgtcacaacccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41655 - RNA, 299 nt, synthetic construct
  source 1..299: mol_type = other RNA
cgctcttccgcgtctcatgtacgtcggggacgtccgcagcgtcacacagaccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41656 - RNA, 299 nt, synthetic construct
  source 1..299: mol_type = other RNA
cgctcttccgcgtctcatgtacgtcggggacgtccgcagcgtcacacagaagacccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41657 - RNA, 299 nt, synthetic construct
  source 1..299: mol_type = other RNA
cgctcttccgcgtctcatgtacgtcggggacgtccgcagcgtcacacagaagcataccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41658 - RNA, 299 nt, synthetic construct
  source 1..299: mol_type = other RNA
cgctcttccgcgtctcatgtacgtcggggacgtccgcagcgtcacacagaagcatatcacccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41659 - RNA, 299 nt, synthetic construct
  source 1..299: mol_type = other RNA
cgctcttccgcgtctcatgtacgtcggggacgtccgcagcgtcacacagaagcatatccagaccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41660 - RNA, 299 nt, synthetic construct
  source 1..299: mol_type = other RNA
cgctcttccgcgtctcatgtacgtcggggacgtccgcagcgtcacacagaagcatatccaggagacctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41661 - RNA, 299 nt, synthetic construct
  source 1..299: mol_type = other RNA
cgctcttccgcgtctcatgtacgtcggggacgtccgcagcgtcacacagaagcatatccaggagtggaccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41662 - RNA, 299 nt, synthetic construct
  source 1..299: mol_type = other RNA
cgctcttccgcgtctcatgtacgtcggggacgtccgcagcgtcacacagaagcatatccaggagtggggcaccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41663 - RNA, 299 nt, synthetic construct
  source 1..299: mol_type = other RNA
cgctcttccgcgtctcatgtacgtcggggacgtccgcagcgtcacacagaagcatatccaggagtggggcccaaccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41664 - RNA, 299 nt, synthetic construct
  source 1..299: mol_type = other RNA
cgctcttccgcgtctcatgtacgtcggggacgtccgcagcgtcacacagaagcatatccaggagtggggcccattcaccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41665 - RNA, 299 nt, synthetic construct
  source 1..299: mol_type = other RNA
cgctcttccgcgtctcatgtacgtcggggacgtccgcagcgtcacacagaagcatatccaggagtggggcccattcgacaccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41666 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgaccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41667 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgaccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41668 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattaccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41669 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaaccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41670 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcaccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41671 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtaccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41672 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccacctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41673 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41674 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacaccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41675 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacaccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41676 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcacctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41677 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccaccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41678 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattaccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41679 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41680 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacacccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41681 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctaccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41682 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccacccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41683 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41684 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagaccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41685 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaaccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41686 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttacctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41687 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttataccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41688 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagaccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41689 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtaccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41690 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactaccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41691 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcacccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41692 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcaccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41693 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcaccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41694 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcacctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41695 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttaccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41696 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagaccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41697 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcacctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41698 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacacccgcctcctgcatgatgcgcggcccaaggagggagatgatcgccccttcttctggctctttgagaatgtggtggccatgggcgttagtgacaagagggacatcgagacgtcggaagagc

SEQ ID NO: 41699 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcaccctcctgcatgatgcgcggcccaaggagggagatgatcgccccttcttctggctctttgagaatgtggtggccatgggcgttagtgacaagagggacatcgagacgtcggaagagc

SEQ ID NO: 41700 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcaccctgcatgatgcgcggcccaaggagggagatgatcgccccttcttctggctctttgagaatgtggtggccatgggcgttagtgacaagagggacatcgagacgtcggaagagc

SEQ ID NO: 41701 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgacccatgatgcgcggcccaaggagggagatgatcgccccttcttctggctctttgagaatgtggtggccatgggcgttagtgacaagagggacatcgagacgtcggaagagc

SEQ ID NO: 41702 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcataccgatgcgcggcccaaggagggagatgatcgccccttcttctggctctttgagaatgtggtggccatgggcgttagtgacaagagggacatcgagacgtcggaagagc

SEQ ID NO: 41703 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgataccgcgcggcccaaggagggagatgatcgccccttcttctggctctttgagaatgtggtggccatgggcgttagtgacaagagggacatcgagacgtcggaagagc

SEQ ID NO: 41704 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgacccggcccaaggagggagatgatcgccccttcttctggctctttgagaatgtggtggccatgggcgttagtgacaagagggacatcgagacgtcggaagagc

SEQ ID NO: 41705 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggacccccaaggagggagatgatcgccccttcttctggctctttgagaatgtggtggccatgggcgttagtgacaagagggacatcgagacgtcggaagagc

SEQ ID NO: 41706 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaccaaggagggagatgatcgccccttcttctggctctttgagaatgtggtggccatgggcgttagtgacaagagggacatcgagacgtcggaagagc

SEQ ID NO: 41707 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagaccgagggagatgatcgccccttcttctggctctttgagaatgtggtggccatgggcgttagtgacaagagggacatcgagacgtcggaagagc

SEQ ID NO: 41708 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagaccggagatgatcgccccttcttctggctctttgagaatgtggtggccatgggcgttagtgacaagagggacatcgagacgtcggaagagc

SEQ ID NO: 41709 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaaccgatgatcgccccttcttctggctctttgagaatgtggtggccatgggcgttagtgacaagagggacatcgagacgtcggaagagc

SEQ ID NO: 41710 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagataccgatcgccccttcttctggctctttgagaatgtggtggccatgggcgttagtgacaagagggacatcgagacgtcggaagagc

SEQ ID NO: 41711 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatacccgccccttcttctggctctttgagaatgtggtggccatgggcgttagtgacaagagggacatcgagacgtcggaagagc

SEQ ID NO: 41712 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcacccccttcttctggctctttgagaatgtggtggccatgggcgttagtgacaagagggacatcgagacgtcggaagagc

SEQ ID NO: 41713 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccaccttcttctggctctttgagaatgtggtggccatgggcgttagtgacaagagggacatcgagacgtcggaagagc

SEQ ID NO: 41714 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcaccttctggctctttgagaatgtggtggccatgggcgttagtgacaagagggacatcgagacgtcggaagagc

SEQ ID NO: 41715 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcacctggctctttgagaatgtggtggccatgggcgttagtgacaagagggacatcgagacgtcggaagagc

SEQ ID NO: 41716 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggaccctctttgagaatgtggtggccatgggcgttagtgacaagagggacatcgagacgtcggaagagc

SEQ ID NO: 41717 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcacctttgagaatgtggtggccatgggcgttagtgacaagagggacatcgagacgtcggaagagc

SEQ ID NO: 41718 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaccgagaatgtggtggccatgggcgttagtgacaagagggacatcgagacgtcggaagagc

SEQ ID NO: 41719 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaccaatgtggtggccatgggcgttagtgacaagagggacatcgagacgtcggaagagc

SEQ ID NO: 41720 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaataccgtggtggccatgggcgttagtgacaagagggacatcgagacgtcggaagagc

SEQ ID NO: 41721 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgaccgtggccatgggcgttagtgacaagagggacatcgagacgtcggaagagc

SEQ ID NO: 41722 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgaccgccatgggcgttagtgacaagagggacatcgagacgtcggaagagc

SEQ ID NO: 41723 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccaccatgggcgttagtgacaagagggacatcgagacgtcggaagagc

SEQ ID NO: 41724 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgaccggcgttagtgacaagagggacatcgagacgtcggaagagc

SEQ ID NO: 41725 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcaccgttagtgacaagagggacatcgagacgtcggaagagc

SEQ ID NO: 41726 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttaccagtgacaagagggacatcgagacgtcggaagagc

SEQ ID NO: 41727 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaccgacaagagggacatcgagacgtcggaagagc

SEQ ID NO: 41728 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaccaagagggacatcgagacgtcggaagagc

SEQ ID NO: 41729 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaccagggacatcgagacgtcggaagagc

SEQ ID NO: 41730 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggaccgacatcgagacgtcggaagagc

SEQ ID NO: 41731 - RNA, 299 nt, synthetic construct
  source 1..299: mol_type = other RNA
cgctcttccgcgtctcatgtacgtctagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41732 - RNA, 299 nt, synthetic construct
  source 1..299: mol_type = other RNA
cgctcttccgcgtctcatgtacgtcgggtaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41733 - RNA, 299 nt, synthetic construct
  source 1..299: mol_type = other RNA
cgctcttccgcgtctcatgtacgtcggggactaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41734 - RNA, 299 nt, synthetic construct
  source 1..299: mol_type = other RNA
cgctcttccgcgtctcatgtacgtcggggacgtctagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41735 - RNA, 299 nt, synthetic construct
  source 1..299: mol_type = other RNA
cgctcttccgcgtctcatgtacgtcggggacgtccgctagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41736 - RNA, 299 nt, synthetic construct
  source 1..299: mol_type = other RNA
cgctcttccgcgtctcatgtacgtcggggacgtccgcagctaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41737 - RNA, 299 nt, synthetic construct
  source 1..299: mol_type = other RNA
cgctcttccgcgtctcatgtacgtcggggacgtccgcagcgtctagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41738 - RNA, 299 nt, synthetic construct
  source 1..299: mol_type = other RNA
cgctcttccgcgtctcatgtacgtcggggacgtccgcagcgtcacatagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41739 - RNA, 299 nt, synthetic construct
  source 1..299: mol_type = other RNA
cgctcttccgcgtctcatgtacgtcggggacgtccgcagcgtcacacagtagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41740 - RNA, 299 nt, synthetic construct
  source 1..299: mol_type = other RNA
cgctcttccgcgtctcatgtacgtcggggacgtccgcagcgtcacacagaagtagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41741 - RNA, 299 nt, synthetic construct
  source 1..299: mol_type = other RNA
cgctcttccgcgtctcatgtacgtcggggacgtccgcagcgtcacacagaagcattagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41742 - RNA, 299 nt, synthetic construct
  source 1..299: mol_type = other RNA
cgctcttccgcgtctcatgtacgtcggggacgtccgcagcgtcacacagaagcatatctagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41743 - RNA, 299 nt, synthetic construct
  source 1..299: mol_type = other RNA
cgctcttccgcgtctcatgtacgtcggggacgtccgcagcgtcacacagaagcatatccagtaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41744 - RNA, 299 nt, synthetic construct
  source 1..299: mol_type = other RNA
cgctcttccgcgtctcatgtacgtcggggacgtccgcagcgtcacacagaagcatatccaggagtagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41745 - RNA, 299 nt, synthetic construct
  source 1..299: mol_type = other RNA
cgctcttccgcgtctcatgtacgtcggggacgtccgcagcgtcacacagaagcatatccaggagtggtagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41746 - RNA, 299 nt, synthetic construct
  source 1..299: mol_type = other RNA
cgctcttccgcgtctcatgtacgtcggggacgtccgcagcgtcacacagaagcatatccaggagtggggctagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41747 - RNA, 299 nt, synthetic construct
  source 1..299: mol_type = other RNA
cgctcttccgcgtctcatgtacgtcggggacgtccgcagcgtcacacagaagcatatccaggagtggggcccatagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41748 - RNA, 299 nt, synthetic construct
  source 1..299: mol_type = other RNA
cgctcttccgcgtctcatgtacgtcggggacgtccgcagcgtcacacagaagcatatccaggagtggggcccattctaggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41749 - RNA, 299 nt, synthetic construct
  source 1..299: mol_type = other RNA
cgctcttccgcgtctcatgtacgtcggggacgtccgcagcgtcacacagaagcatatccaggagtggggcccattcgactagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41750 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgtaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41751 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgtagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41752 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatttagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41753 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggatagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41754 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggctagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41755 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagttagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41756 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41757 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgctagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41758 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaactaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41759 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgactagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41760 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41761 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcctagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41762 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatttaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41763 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41764 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41765 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41766 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41767 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41768 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41769 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41770 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41771 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41772 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41773 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41774 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41775 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41776 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41777 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41778 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41779 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41780 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41781 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41782 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactagcgcctcctgcatgatgcgcggcccaaggagggagatgatcgccccttcttctggctctttgagaatgtggtggccatgggcgttagtgacaagagggacatcgagacgtcggaagagc

SEQ ID NO: 41783 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctagctcctgcatgatgcgcggcccaaggagggagatgatcgccccttcttctggctctttgagaatgtggtggccatgggcgttagtgacaagagggacatcgagacgtcggaagagc

SEQ ID NO: 41784 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctagctgcatgatgcgcggcccaaggagggagatgatcgccccttcttctggctctttgagaatgtggtggccatgggcgttagtgacaagagggacatcgagacgtcggaagagc

SEQ ID NO: 41785 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtagcatgatgcgcggcccaaggagggagatgatcgccccttcttctggctctttgagaatgtggtggccatgggcgttagtgacaagagggacatcgagacgtcggaagagc

SEQ ID NO: 41786 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattaggatgcgcggcccaaggagggagatgatcgccccttcttctggctctttgagaatgtggtggccatgggcgttagtgacaagagggacatcgagacgtcggaagagc

SEQ ID NO: 41787 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattaggcgcggcccaaggagggagatgatcgccccttcttctggctctttgagaatgtggtggccatgggcgttagtgacaagagggacatcgagacgtcggaagagc

SEQ ID NO: 41788 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtagcggcccaaggagggagatgatcgccccttcttctggctctttgagaatgtggtggccatgggcgttagtgacaagagggacatcgagacgtcggaagagc

SEQ ID NO: 41789 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtagcccaaggagggagatgatcgccccttcttctggctctttgagaatgtggtggccatgggcgttagtgacaagagggacatcgagacgtcggaagagc

SEQ ID NO: 41790 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctagaaggagggagatgatcgccccttcttctggctctttgagaatgtggtggccatgggcgttagtgacaagagggacatcgagacgtcggaagagc

SEQ ID NO: 41791 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtaggagggagatgatcgccccttcttctggctctttgagaatgtggtggccatgggcgttagtgacaagagggacatcgagacgtcggaagagc

SEQ ID NO: 41792 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtagggagatgatcgccccttcttctggctctttgagaatgtggtggccatgggcgttagtgacaagagggacatcgagacgtcggaagagc

SEQ ID NO: 41793 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggataggatgatcgccccttcttctggctctttgagaatgtggtggccatgggcgttagtgacaagagggacatcgagacgtcggaagagc

SEQ ID NO: 41794 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattaggatcgccccttcttctggctctttgagaatgtggtggccatgggcgttagtgacaagagggacatcgagacgtcggaagagc

SEQ ID NO: 41795 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattagcgccccttcttctggctctttgagaatgtggtggccatgggcgttagtgacaagagggacatcgagacgtcggaagagc

SEQ ID NO: 41796 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctagcccttcttctggctctttgagaatgtggtggccatgggcgttagtgacaagagggacatcgagacgtcggaagagc

SEQ ID NO: 41797 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctagttcttctggctctttgagaatgtggtggccatgggcgttagtgacaagagggacatcgagacgtcggaagagc

SEQ ID NO: 41798 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctagttctggctctttgagaatgtggtggccatgggcgttagtgacaagagggacatcgagacgtcggaagagc

SEQ ID NO: 41799 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctagtggctctttgagaatgtggtggccatgggcgttagtgacaagagggacatcgagacgtcggaagagc

SEQ ID NO: 41800 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtagctctttgagaatgtggtggccatgggcgttagtgacaagagggacatcgagacgtcggaagagc

SEQ ID NO: 41801 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctagtttgagaatgtggtggccatgggcgttagtgacaagagggacatcgagacgtcggaagagc

SEQ ID NO: 41802 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttaggagaatgtggtggccatgggcgttagtgacaagagggacatcgagacgtcggaagagc

SEQ ID NO: 41803 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtagaatgtggtggccatgggcgttagtgacaagagggacatcgagacgtcggaagagc

SEQ ID NO: 41804 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattaggtggtggccatgggcgttagtgacaagagggacatcgagacgtcggaagagc

SEQ ID NO: 41805 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtaggtggccatgggcgttagtgacaagagggacatcgagacgtcggaagagc

SEQ ID NO: 41806 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtaggccatgggcgttagtgacaagagggacatcgagacgtcggaagagc

SEQ ID NO: 41807 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctagatgggcgttagtgacaagagggacatcgagacgtcggaagagc

SEQ ID NO: 41808 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtagggcgttagtgacaagagggacatcgagacgtcggaagagc

SEQ ID NO: 41809 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctaggttagtgacaagagggacatcgagacgtcggaagagc

SEQ ID NO: 41810 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttagagtgacaagagggacatcgagacgtcggaagagc

SEQ ID NO: 41811 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttaggacaagagggacatcgagacgtcggaagagc

SEQ ID NO: 41812 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactagaagagggacatcgagacgtcggaagagc

SEQ ID NO: 41813 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtagagggacatcgagacgtcggaagagc

SEQ ID NO: 41814 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggtaggacatcgagacgtcggaagagc

SEQ ID NO: 41815 - RNA, 299 nt, synthetic construct
  source 1..299: mol_type = other RNA
cgctcttccgcgtctcatgtacgtctacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41816 - RNA, 299 nt, synthetic construct
  source 1..299: mol_type = other RNA
cgctcttccgcgtctcatgtacgtcgggtacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41817 - RNA, 299 nt, synthetic construct
  source 1..299: mol_type = other RNA
cgctcttccgcgtctcatgtacgtcggggactacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41818 - RNA, 299 nt, synthetic construct
  source 1..299: mol_type = other RNA
cgctcttccgcgtctcatgtacgtcggggacgtctaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41819 - RNA, 299 nt, synthetic construct
  source 1..299: mol_type = other RNA
cgctcttccgcgtctcatgtacgtcggggacgtccgctacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41820 - RNA, 299 nt, synthetic construct
  source 1..299: mol_type = other RNA
cgctcttccgcgtctcatgtacgtcggggacgtccgcagctacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41821 - RNA, 299 nt, synthetic construct
  source 1..299: mol_type = other RNA
cgctcttccgcgtctcatgtacgtcggggacgtccgcagcgtctacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41822 - RNA, 299 nt, synthetic construct
  source 1..299: mol_type = other RNA
cgctcttccgcgtctcatgtacgtcggggacgtccgcagcgtcacataccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41823 - RNA, 299 nt, synthetic construct
  source 1..299: mol_type = other RNA
cgctcttccgcgtctcatgtacgtcggggacgtccgcagcgtcacacagtacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41824 - RNA, 299 nt, synthetic construct
  source 1..299: mol_type = other RNA
cgctcttccgcgtctcatgtacgtcggggacgtccgcagcgtcacacagaagtaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41825 - RNA, 299 nt, synthetic construct
  source 1..299: mol_type = other RNA
cgctcttccgcgtctcatgtacgtcggggacgtccgcagcgtcacacagaagcattacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41826 - RNA, 299 nt, synthetic construct
  source 1..299: mol_type = other RNA
cgctcttccgcgtctcatgtacgtcggggacgtccgcagcgtcacacagaagcatatctaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41827 - RNA, 299 nt, synthetic construct
  source 1..299: mol_type = other RNA
cgctcttccgcgtctcatgtacgtcggggacgtccgcagcgtcacacagaagcatatccagtacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41828 - RNA, 299 nt, synthetic construct
  source 1..299: mol_type = other RNA
cgctcttccgcgtctcatgtacgtcggggacgtccgcagcgtcacacagaagcatatccaggagtactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41829 - RNA, 299 nt, synthetic construct
  source 1..299: mol_type = other RNA
cgctcttccgcgtctcatgtacgtcggggacgtccgcagcgtcacacagaagcatatccaggagtggtacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41830 - RNA, 299 nt, synthetic construct
  source 1..299: mol_type = other RNA
cgctcttccgcgtctcatgtacgtcggggacgtccgcagcgtcacacagaagcatatccaggagtggggctacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41831 - RNA, 299 nt, synthetic construct
  source 1..299: mol_type = other RNA
cgctcttccgcgtctcatgtacgtcggggacgtccgcagcgtcacacagaagcatatccaggagtggggcccatacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41832 - RNA, 299 nt, synthetic construct
  source 1..299: mol_type = other RNA
cgctcttccgcgtctcatgtacgtcggggacgtccgcagcgtcacacagaagcatatccaggagtggggcccattctacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41833 - RNA, 299 nt, synthetic construct
  source 1..299: mol_type = other RNA
cgctcttccgcgtctcatgtacgtcggggacgtccgcagcgtcacacagaagcatatccaggagtggggcccattcgactacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41834 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgtacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41835 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgtacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41836 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatttacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41837 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggatacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41838 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggctacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41839 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagttacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41840 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41841 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgctacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41842 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaactacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41843 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgactacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41844 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41845 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcctacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41846 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatttacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41847 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41848 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41849 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41850 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41851 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41852 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41853 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41854 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41855 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41856 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41857 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41858 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41859 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41860 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41861 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41862 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41863 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41864 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41865 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41866 - RNA, 299 nt, synthetic construct; identical to SEQ ID NO: 41865
  source 1..299: mol_type = other RNA

SEQ ID NO: 41867 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctacctcctgcatgatgcgcggcccaaggagggagatgatcgccccttcttctggctctttgagaatgtggtggccatgggcgttagtgacaagagggacatcgagacgtcggaagagc

SEQ ID NO: 41868 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctacctgcatgatgcgcggcccaaggagggagatgatcgccccttcttctggctctttgagaatgtggtggccatgggcgttagtgacaagagggacatcgagacgtcggaagagc

SEQ ID NO: 41869 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtaccatgatgcgcggcccaaggagggagatgatcgccccttcttctggctctttgagaatgtggtggccatgggcgttagtgacaagagggacatcgagacgtcggaagagc

SEQ ID NO: 41870 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattacgatgcgcggcccaaggagggagatgatcgccccttcttctggctctttgagaatgtggtggccatgggcgttagtgacaagagggacatcgagacgtcggaagagc

SEQ ID NO: 41871 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattacgcgcggcccaaggagggagatgatcgccccttcttctggctctttgagaatgtggtggccatgggcgttagtgacaagagggacatcgagacgtcggaagagc

SEQ ID NO: 41872 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtaccggcccaaggagggagatgatcgccccttcttctggctctttgagaatgtggtggccatgggcgttagtgacaagagggacatcgagacgtcggaagagc

SEQ ID NO: 41873 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtaccccaaggagggagatgatcgccccttcttctggctctttgagaatgtggtggccatgggcgttagtgacaagagggacatcgagacgtcggaagagc

SEQ ID NO: 41874 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctacaaggagggagatgatcgccccttcttctggctctttgagaatgtggtggccatgggcgttagtgacaagagggacatcgagacgtcggaagagc

SEQ ID NO: 41875 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtacgagggagatgatcgccccttcttctggctctttgagaatgtggtggccatgggcgttagtgacaagagggacatcgagacgtcggaagagc

SEQ ID NO: 41876 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtacggagatgatcgccccttcttctggctctttgagaatgtggtggccatgggcgttagtgacaagagggacatcgagacgtcggaagagc

SEQ ID NO: 41877 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatacgatgatcgccccttcttctggctctttgagaatgtggtggccatgggcgttagtgacaagagggacatcgagacgtcggaagagc

SEQ ID NO: 41878 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattacgatcgccccttcttctggctctttgagaatgtggtggccatgggcgttagtgacaagagggacatcgagacgtcggaagagc

SEQ ID NO: 41879 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattaccgccccttcttctggctctttgagaatgtggtggccatgggcgttagtgacaagagggacatcgagacgtcggaagagc

SEQ ID NO: 41880 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctaccccttcttctggctctttgagaatgtggtggccatgggcgttagtgacaagagggacatcgagacgtcggaagagc

SEQ ID NO: 41881 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctacttcttctggctctttgagaatgtggtggccatgggcgttagtgacaagagggacatcgagacgtcggaagagc

SEQ ID NO: 41882 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctacttctggctctttgagaatgtggtggccatgggcgttagtgacaagagggacatcgagacgtcggaagagc

SEQ ID NO: 41883 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctactggctctttgagaatgtggtggccatgggcgttagtgacaagagggacatcgagacgtcggaagagc

SEQ ID NO: 41884 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtacctctttgagaatgtggtggccatgggcgttagtgacaagagggacatcgagacgtcggaagagc

SEQ ID NO: 41885 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctactttgagaatgtggtggccatgggcgttagtgacaagagggacatcgagacgtcggaagagc

SEQ ID NO: 41886 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttacgagaatgtggtggccatgggcgttagtgacaagagggacatcgagacgtcggaagagc

SEQ ID NO: 41887 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtacaatgtggtggccatgggcgttagtgacaagagggacatcgagacgtcggaagagc

SEQ ID NO: 41888 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattacgtggtggccatgggcgttagtgacaagagggacatcgagacgtcggaagagc

SEQ ID NO: 41889 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtacgtggccatgggcgttagtgacaagagggacatcgagacgtcggaagagc

SEQ ID NO: 41890 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtacgccatgggcgttagtgacaagagggacatcgagacgtcggaagagc

SEQ ID NO: 41891 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctacatgggcgttagtgacaagagggacatcgagacgtcggaagagc

SEQ ID NO: 41892 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtacggcgttagtgacaagagggacatcgagacgtcggaagagc

SEQ ID NO: 41893 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctacgttagtgacaagagggacatcgagacgtcggaagagc

SEQ ID NO: 41894 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttacagtgacaagagggacatcgagacgtcggaagagc

SEQ ID NO: 41895 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttacgacaagagggacatcgagacgtcggaagagc

SEQ ID NO: 41896 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactacaagagggacatcgagacgtcggaagagc

SEQ ID NO: 41897 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtacagggacatcgagacgtcggaagagc

SEQ ID NO: 41898 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggtacgacatcgagacgtcggaagagc

SEQ ID NO: 41899 - RNA, 299 nt, synthetic construct
  source 1..299: mol_type = other RNA
cgctcttccgcgtctcatgtacgtcttgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41900 - RNA, 299 nt, synthetic construct
  source 1..299: mol_type = other RNA
cgctcttccgcgtctcatgtacgtcgggttggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41901 - RNA, 299 nt, synthetic construct
  source 1..299: mol_type = other RNA
cgctcttccgcgtctcatgtacgtcggggacttggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41902 - RNA, 299 nt, synthetic construct
  source 1..299: mol_type = other RNA
cgctcttccgcgtctcatgtacgtcggggacgtcttgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41903 - RNA, 299 nt, synthetic construct
  source 1..299: mol_type = other RNA
cgctcttccgcgtctcatgtacgtcggggacgtccgcttgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41904 - RNA, 299 nt, synthetic construct
  source 1..299: mol_type = other RNA
cgctcttccgcgtctcatgtacgtcggggacgtccgcagcttggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41905 - RNA, 299 nt, synthetic construct
  source 1..299: mol_type = other RNA
cgctcttccgcgtctcatgtacgtcggggacgtccgcagcgtcttgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41906 - RNA, 299 nt, synthetic construct
  source 1..299: mol_type = other RNA
cgctcttccgcgtctcatgtacgtcggggacgtccgcagcgtcacattgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41907 - RNA, 299 nt, synthetic construct
  source 1..299: mol_type = other RNA
cgctcttccgcgtctcatgtacgtcggggacgtccgcagcgtcacacagttgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41908 - RNA, 299 nt, synthetic construct
  source 1..299: mol_type = other RNA
cgctcttccgcgtctcatgtacgtcggggacgtccgcagcgtcacacagaagttgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41909 - RNA, 299 nt, synthetic construct
  source 1..299: mol_type = other RNA
cgctcttccgcgtctcatgtacgtcggggacgtccgcagcgtcacacagaagcatttgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41910 - RNA, 299 nt, synthetic construct
  source 1..299: mol_type = other RNA
cgctcttccgcgtctcatgtacgtcggggacgtccgcagcgtcacacagaagcatatcttgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41911 - RNA, 299 nt, synthetic construct
  source 1..299: mol_type = other RNA
cgctcttccgcgtctcatgtacgtcggggacgtccgcagcgtcacacagaagcatatccagttggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41912 - RNA, 299 nt, synthetic construct
  source 1..299: mol_type = other RNA
cgctcttccgcgtctcatgtacgtcggggacgtccgcagcgtcacacagaagcatatccaggagttgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41913 - RNA, 299 nt, synthetic construct
  source 1..299: mol_type = other RNA
cgctcttccgcgtctcatgtacgtcggggacgtccgcagcgtcacacagaagcatatccaggagtggttgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41914 - RNA, 299 nt, synthetic construct
  source 1..299: mol_type = other RNA
cgctcttccgcgtctcatgtacgtcggggacgtccgcagcgtcacacagaagcatatccaggagtggggcttgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41915 - RNA, 299 nt, synthetic construct
  source 1..299: mol_type = other RNA
cgctcttccgcgtctcatgtacgtcggggacgtccgcagcgtcacacagaagcatatccaggagtggggcccattgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41916 - RNA, 299 nt, synthetic construct
  source 1..299: mol_type = other RNA
cgctcttccgcgtctcatgtacgtcggggacgtccgcagcgtcacacagaagcatatccaggagtggggcccattcttggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41917 - RNA, 299 nt, synthetic construct
  source 1..299: mol_type = other RNA
cgctcttccgcgtctcatgtacgtcggggacgtccgcagcgtcacacagaagcatatccaggagtggggcccattcgacttgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41918 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgttggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41919 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgttgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41920 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattttgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41921 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggattgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41922 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcttgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41923 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtttgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41924 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccttgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41925 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcttgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41926 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacttggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41927 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacttgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41928 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcttgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41929 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccttgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41930 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattttggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41931 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcttgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41932 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacttgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41933 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctttggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41934 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccttgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41935 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcttgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41936 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagttgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41937 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggattgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41938 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttttgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41939 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatttggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41940 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagttgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41941 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtttgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41942 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactttgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41943 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcttgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41944 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcttgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41945 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41946 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41947 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttttggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41948 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41949 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcttgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41950 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacttgcgcctcctgcatgatgcgcggcccaaggagggagatgatcgccccttcttctggctctttgagaatgtggtggccatgggcgttagtgacaagagggacatcgagacgtcggaagagc

SEQ ID NO: 41951 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcttgctcctgcatgatgcgcggcccaaggagggagatgatcgccccttcttctggctctttgagaatgtggtggccatgggcgttagtgacaagagggacatcgagacgtcggaagagc

SEQ ID NO: 41952 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcttgctgcatgatgcgcggcccaaggagggagatgatcgccccttcttctggctctttgagaatgtggtggccatgggcgttagtgacaagagggacatcgagacgtcggaagagc

SEQ ID NO: 41953 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgttgcatgatgcgcggcccaaggagggagatgatcgccccttcttctggctctttgagaatgtggtggccatgggcgttagtgacaagagggacatcgagacgtcggaagagc

SEQ ID NO: 41954 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatttggatgcgcggcccaaggagggagatgatcgccccttcttctggctctttgagaatgtggtggccatgggcgttagtgacaagagggacatcgagacgtcggaagagc

SEQ ID NO: 41955 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatttggcgcggcccaaggagggagatgatcgccccttcttctggctctttgagaatgtggtggccatgggcgttagtgacaagagggacatcgagacgtcggaagagc

SEQ ID NO: 41956 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgttgcggcccaaggagggagatgatcgccccttcttctggctctttgagaatgtggtggccatgggcgttagtgacaagagggacatcgagacgtcggaagagc

SEQ ID NO: 41957 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggttgcccaaggagggagatgatcgccccttcttctggctctttgagaatgtggtggccatgggcgttagtgacaagagggacatcgagacgtcggaagagc

SEQ ID NO: 41958 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccttgaaggagggagatgatcgccccttcttctggctctttgagaatgtggtggccatgggcgttagtgacaagagggacatcgagacgtcggaagagc

SEQ ID NO: 41959 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagttggagggagatgatcgccccttcttctggctctttgagaatgtggtggccatgggcgttagtgacaagagggacatcgagacgtcggaagagc

SEQ ID NO: 41960 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagttgggagatgatcgccccttcttctggctctttgagaatgtggtggccatgggcgttagtgacaagagggacatcgagacgtcggaagagc

SEQ ID NO: 41961 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggattggatgatcgccccttcttctggctctttgagaatgtggtggccatgggcgttagtgacaagagggacatcgagacgtcggaagagc

SEQ ID NO: 41962 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatttggatcgccccttcttctggctctttgagaatgtggtggccatgggcgttagtgacaagagggacatcgagacgtcggaagagc

SEQ ID NO: 41963 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatttgcgccccttcttctggctctttgagaatgtggtggccatgggcgttagtgacaagagggacatcgagacgtcggaagagc

SEQ ID NO: 41964 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcttgcccttcttctggctctttgagaatgtggtggccatgggcgttagtgacaagagggacatcgagacgtcggaagagc

SEQ ID NO: 41965 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttgttcttctggctctttgagaatgtggtggccatgggcgttagtgacaagagggacatcgagacgtcggaagagc

SEQ ID NO: 41966 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttgttctggctctttgagaatgtggtggccatgggcgttagtgacaagagggacatcgagacgtcggaagagc

SEQ ID NO: 41967 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcttgtggctctttgagaatgtggtggccatgggcgttagtgacaagagggacatcgagacgtcggaagagc

SEQ ID NO: 41968 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggttgctctttgagaatgtggtggccatgggcgttagtgacaagagggacatcgagacgtcggaagagc

SEQ ID NO: 41969 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttgtttgagaatgtggtggccatgggcgttagtgacaagagggacatcgagacgtcggaagagc

SEQ ID NO: 41970 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttttggagaatgtggtggccatgggcgttagtgacaagagggacatcgagacgtcggaagagc

SEQ ID NO: 41971 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagttgaatgtggtggccatgggcgttagtgacaagagggacatcgagacgtcggaagagc

SEQ ID NO: 41972 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatttggtggtggccatgggcgttagtgacaagagggacatcgagacgtcggaagagc

SEQ ID NO: 41973 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgttggtggccatgggcgttagtgacaagagggacatcgagacgtcggaagagc

SEQ ID NO: 41974 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgttggccatgggcgttagtgacaagagggacatcgagacgtcggaagagc

SEQ ID NO: 41975 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccttgatgggcgttagtgacaagagggacatcgagacgtcggaagagc

SEQ ID NO: 41976 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgttgggcgttagtgacaagagggacatcgagacgtcggaagagc

SEQ ID NO: 41977 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcttggttagtgacaagagggacatcgagacgtcggaagagc

SEQ ID NO: 41978 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttttgagtgacaagagggacatcgagacgtcggaagagc

SEQ ID NO: 41979 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtttggacaagagggacatcgagacgtcggaagagc

SEQ ID NO: 41980 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacttgaagagggacatcgagacgtcggaagagc

SEQ ID NO: 41981 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagttgagggacatcgagacgtcggaagagc

SEQ ID NO: 41982 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggttggacatcgagacgtcggaagagc

SEQ ID NO: 41983 - RNA, 299 nt, synthetic construct
  source 1..299: mol_type = other RNA
cgctcttccgcgtctcatgtacgtcttcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41984 - RNA, 299 nt, synthetic construct
  source 1..299: mol_type = other RNA
cgctcttccgcgtctcatgtacgtcgggttcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41985 - RNA, 299 nt, synthetic construct
  source 1..299: mol_type = other RNA
cgctcttccgcgtctcatgtacgtcggggacttcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41986 - RNA, 299 nt, synthetic construct
  source 1..299: mol_type = other RNA
cgctcttccgcgtctcatgtacgtcggggacgtcttccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41987 - RNA, 299 nt, synthetic construct
  source 1..299: mol_type = other RNA
cgctcttccgcgtctcatgtacgtcggggacgtccgcttcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41988 - RNA, 299 nt, synthetic construct
  source 1..299: mol_type = other RNA
cgctcttccgcgtctcatgtacgtcggggacgtccgcagcttcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41989 - RNA, 299 nt, synthetic construct
  source 1..299: mol_type = other RNA
cgctcttccgcgtctcatgtacgtcggggacgtccgcagcgtcttcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41990 - RNA, 299 nt, synthetic construct
  source 1..299: mol_type = other RNA
cgctcttccgcgtctcatgtacgtcggggacgtccgcagcgtcacattccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41991 - RNA, 299 nt, synthetic construct
  source 1..299: mol_type = other RNA
cgctcttccgcgtctcatgtacgtcggggacgtccgcagcgtcacacagttcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41992 - RNA, 299 nt, synthetic construct
  source 1..299: mol_type = other RNA
cgctcttccgcgtctcatgtacgtcggggacgtccgcagcgtcacacagaagttccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41993 - RNA, 299 nt, synthetic construct
  source 1..299: mol_type = other RNA
cgctcttccgcgtctcatgtacgtcggggacgtccgcagcgtcacacagaagcatttcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41994 - RNA, 299 nt, synthetic construct
  source 1..299: mol_type = other RNA
cgctcttccgcgtctcatgtacgtcggggacgtccgcagcgtcacacagaagcatatcttccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41995 - RNA, 299 nt, synthetic construct
  source 1..299: mol_type = other RNA
cgctcttccgcgtctcatgtacgtcggggacgtccgcagcgtcacacagaagcatatccagttcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41996 - RNA, 299 nt, synthetic construct
  source 1..299: mol_type = other RNA
cgctcttccgcgtctcatgtacgtcggggacgtccgcagcgtcacacagaagcatatccaggagttctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41997 - RNA, 299 nt, synthetic construct
  source 1..299: mol_type = other RNA
cgctcttccgcgtctcatgtacgtcggggacgtccgcagcgtcacacagaagcatatccaggagtggttcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41998 - RNA, 299 nt, synthetic construct
  source 1..299: mol_type = other RNA
cgctcttccgcgtctcatgtacgtcggggacgtccgcagcgtcacacagaagcatatccaggagtggggcttcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 41999 - RNA, 299 nt, synthetic construct
  source 1..299: mol_type = other RNA
cgctcttccgcgtctcatgtacgtcggggacgtccgcagcgtcacacagaagcatatccaggagtggggcccattcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42000 - RNA, 299 nt, synthetic construct; identical to SEQ ID NO: 41999
  source 1..299: mol_type = other RNA

SEQ ID NO: 42001 - RNA, 299 nt, synthetic construct
  source 1..299: mol_type = other RNA
cgctcttccgcgtctcatgtacgtcggggacgtccgcagcgtcacacagaagcatatccaggagtggggcccattcgacttcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42002 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgttcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42003 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgttcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42004 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattttcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42005 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggattcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42006 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcttcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42007 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtttcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42008 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccttctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42009 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcttcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42010 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacttcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42011 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacttcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42012 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcttctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42013 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccttcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42014 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattttcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42015 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcttcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42016 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacttccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42017 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctttcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42018 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccttccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42019 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcttcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42020 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagttcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42021 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggattcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42022 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttttctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42023 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatttcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42024 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagttcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42025 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtttcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42026 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactttcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42027 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcttccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42028 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcttcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42029 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42030 - RNA, 299 nt, synthetic construct; identical to SEQ ID NO: 42029
  source 1..299: mol_type = other RNA

SEQ ID NO: 42031 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttttcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42032 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42033 - RNA, 299 nt, synthetic construct; identical to SEQ ID NO: 42032
  source 1..299: mol_type = other RNA

SEQ ID NO: 42034 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacttccgcctcctgcatgatgcgcggcccaaggagggagatgatcgccccttcttctggctctttgagaatgtggtggccatgggcgttagtgacaagagggacatcgagacgtcggaagagc

SEQ ID NO: 42035 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcttcctcctgcatgatgcgcggcccaaggagggagatgatcgccccttcttctggctctttgagaatgtggtggccatgggcgttagtgacaagagggacatcgagacgtcggaagagc

SEQ ID NO: 42036 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcttcctgcatgatgcgcggcccaaggagggagatgatcgccccttcttctggctctttgagaatgtggtggccatgggcgttagtgacaagagggacatcgagacgtcggaagagc

SEQ ID NO: 42037 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgttccatgatgcgcggcccaaggagggagatgatcgccccttcttctggctctttgagaatgtggtggccatgggcgttagtgacaagagggacatcgagacgtcggaagagc

SEQ ID NO: 42038 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatttcgatgcgcggcccaaggagggagatgatcgccccttcttctggctctttgagaatgtggtggccatgggcgttagtgacaagagggacatcgagacgtcggaagagc

SEQ ID NO: 42039 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatttcgcgcggcccaaggagggagatgatcgccccttcttctggctctttgagaatgtggtggccatgggcgttagtgacaagagggacatcgagacgtcggaagagc

SEQ ID NO: 42040 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgttccggcccaaggagggagatgatcgccccttcttctggctctttgagaatgtggtggccatgggcgttagtgacaagagggacatcgagacgtcggaagagc

SEQ ID NO: 42041 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggttccccaaggagggagatgatcgccccttcttctggctctttgagaatgtggtggccatgggcgttagtgacaagagggacatcgagacgtcggaagagc

SEQ ID NO: 42042 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccttcaaggagggagatgatcgccccttcttctggctctttgagaatgtggtggccatgggcgttagtgacaagagggacatcgagacgtcggaagagc

SEQ ID NO: 42043 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagttcgagggagatgatcgccccttcttctggctctttgagaatgtggtggccatgggcgttagtgacaagagggacatcgagacgtcggaagagc

SEQ ID NO: 42044 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagttcggagatgatcgccccttcttctggctctttgagaatgtggtggccatgggcgttagtgacaagagggacatcgagacgtcggaagagc

SEQ ID NO: 42045 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggattcgatgatcgccccttcttctggctctttgagaatgtggtggccatgggcgttagtgacaagagggacatcgagacgtcggaagagc

SEQ ID NO: 42046 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatttcgatcgccccttcttctggctctttgagaatgtggtggccatgggcgttagtgacaagagggacatcgagacgtcggaagagc

SEQ ID NO: 42047 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatttccgccccttcttctggctctttgagaatgtggtggccatgggcgttagtgacaagagggacatcgagacgtcggaagagc

SEQ ID NO: 42048 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcttccccttcttctggctctttgagaatgtggtggccatgggcgttagtgacaagagggacatcgagacgtcggaagagc

SEQ ID NO: 42049 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcttctggctctttgagaatgtggtggccatgggcgttagtgacaagagggacatcgagacgtcggaagagc

SEQ ID NO: 42050 - RNA, 299 nt, synthetic construct; identical to SEQ ID NO: 42049
  source 1..299: mol_type = other RNA

SEQ ID NO: 42051 - RNA, 299 nt, synthetic construct; identical to SEQ ID NO: 42049
  source 1..299: mol_type = other RNA

SEQ ID NO: 42052 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggttcctctttgagaatgtggtggccatgggcgttagtgacaagagggacatcgagacgtcggaagagc

SEQ ID NO: 42053 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttctttgagaatgtggtggccatgggcgttagtgacaagagggacatcgagacgtcggaagagc

SEQ ID NO: 42054 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttttcgagaatgtggtggccatgggcgttagtgacaagagggacatcgagacgtcggaagagc

SEQ ID NO: 42055 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagttcaatgtggtggccatgggcgttagtgacaagagggacatcgagacgtcggaagagc

SEQ ID NO: 42056 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatttcgtggtggccatgggcgttagtgacaagagggacatcgagacgtcggaagagc

SEQ ID NO: 42057 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgttcgtggccatgggcgttagtgacaagagggacatcgagacgtcggaagagc

SEQ ID NO: 42058 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgttcgccatgggcgttagtgacaagagggacatcgagacgtcggaagagc

SEQ ID NO: 42059 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccttcatgggcgttagtgacaagagggacatcgagacgtcggaagagc

SEQ ID NO: 42060 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgttcggcgttagtgacaagagggacatcgagacgtcggaagagc

SEQ ID NO: 42061 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcttcgttagtgacaagagggacatcgagacgtcggaagagc

SEQ ID NO: 42062 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttttcagtgacaagagggacatcgagacgtcggaagagc

SEQ ID NO: 42063 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtttcgacaagagggacatcgagacgtcggaagagc

SEQ ID NO: 42064 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacttcaagagggacatcgagacgtcggaagagc

SEQ ID NO: 42065 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagttcagggacatcgagacgtcggaagagc

SEQ ID NO: 42066 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggttcgacatcgagacgtcggaagagc

SEQ ID NO: 42067 - RNA, 299 nt, synthetic construct
  source 1..299: mol_type = other RNA
cgctcttccgcgtctcatgtacgtctggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42068 - RNA, 299 nt, synthetic construct
  source 1..299: mol_type = other RNA
cgctcttccgcgtctcatgtacgtcgggtgggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42069 - RNA, 299 nt, synthetic construct
  source 1..299: mol_type = other RNA
cgctcttccgcgtctcatgtacgtcggggactgggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42070 - RNA, 299 nt, synthetic construct
  source 1..299: mol_type = other RNA
cgctcttccgcgtctcatgtacgtcggggacgtctggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42071 - RNA, 299 nt, synthetic construct
  source 1..299: mol_type = other RNA
cgctcttccgcgtctcatgtacgtcggggacgtccgctggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42072 - RNA, 299 nt, synthetic construct
  source 1..299: mol_type = other RNA
cgctcttccgcgtctcatgtacgtcggggacgtccgcagctgggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42073 - RNA, 299 nt, synthetic construct
  source 1..299: mol_type = other RNA
cgctcttccgcgtctcatgtacgtcggggacgtccgcagcgtctggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42074 - RNA, 299 nt, synthetic construct
  source 1..299: mol_type = other RNA
cgctcttccgcgtctcatgtacgtcggggacgtccgcagcgtcacatggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42075 - RNA, 299 nt, synthetic construct
  source 1..299: mol_type = other RNA
cgctcttccgcgtctcatgtacgtcggggacgtccgcagcgtcacacagtggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42076 - RNA, 299 nt, synthetic construct
  source 1..299: mol_type = other RNA
cgctcttccgcgtctcatgtacgtcggggacgtccgcagcgtcacacagaagtggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42077 - RNA, 299 nt, synthetic construct
  source 1..299: mol_type = other RNA
cgctcttccgcgtctcatgtacgtcggggacgtccgcagcgtcacacagaagcattggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42078 - RNA, 299 nt, synthetic construct
  source 1..299: mol_type = other RNA
cgctcttccgcgtctcatgtacgtcggggacgtccgcagcgtcacacagaagcatatctggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42079 - RNA, 299 nt, synthetic construct
  source 1..299: mol_type = other RNA
cgctcttccgcgtctcatgtacgtcggggacgtccgcagcgtcacacagaagcatatccagtgggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42080 - RNA, 299 nt, synthetic construct
  source 1..299: mol_type = other RNA
cgctcttccgcgtctcatgtacgtcggggacgtccgcagcgtcacacagaagcatatccaggagtggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42081 - RNA, 299 nt, synthetic construct; identical to SEQ ID NO: 42080
  source 1..299: mol_type = other RNA

SEQ ID NO: 42082 - RNA, 299 nt, synthetic construct
  source 1..299: mol_type = other RNA
cgctcttccgcgtctcatgtacgtcggggacgtccgcagcgtcacacagaagcatatccaggagtggggctggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42083 - RNA, 299 nt, synthetic construct
  source 1..299: mol_type = other RNA
cgctcttccgcgtctcatgtacgtcggggacgtccgcagcgtcacacagaagcatatccaggagtggggcccatggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42084 - RNA, 299 nt, synthetic construct
  source 1..299: mol_type = other RNA
cgctcttccgcgtctcatgtacgtcggggacgtccgcagcgtcacacagaagcatatccaggagtggggcccattctgggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42085 - RNA, 299 nt, synthetic construct
  source 1..299: mol_type = other RNA
cgctcttccgcgtctcatgtacgtcggggacgtccgcagcgtcacacagaagcatatccaggagtggggcccattcgactggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42086 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgtgggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42087 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgtggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42088 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatttggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42089 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggatggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42090 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggctggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42091 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagttggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42092 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42093 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgctggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42094 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaactgggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42095 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgactggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42096 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42097 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcctggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42098 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatttgggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42099 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42100 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42101 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttgggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42102 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42103 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42104 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42105 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42106 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42107 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattgggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42108 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42109 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42110 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42111 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42112 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42113 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42114 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42115 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttgggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42116 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42117 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42118 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactggcgcctcctgcatgatgcgcggcccaaggagggagatgatcgccccttcttctggctctttgagaatgtggtggccatgggcgttagtgacaagagggacatcgagacgtcggaagagc

SEQ ID NO: 42119 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctggctcctgcatgatgcgcggcccaaggagggagatgatcgccccttcttctggctctttgagaatgtggtggccatgggcgttagtgacaagagggacatcgagacgtcggaagagc

SEQ ID NO: 42120 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctggctgcatgatgcgcggcccaaggagggagatgatcgccccttcttctggctctttgagaatgtggtggccatgggcgttagtgacaagagggacatcgagacgtcggaagagc

SEQ ID NO: 42121 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtggcatgatgcgcggcccaaggagggagatgatcgccccttcttctggctctttgagaatgtggtggccatgggcgttagtgacaagagggacatcgagacgtcggaagagc

SEQ ID NO: 42122 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattgggatgcgcggcccaaggagggagatgatcgccccttcttctggctctttgagaatgtggtggccatgggcgttagtgacaagagggacatcgagacgtcggaagagc

SEQ ID NO: 42123 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattgggcgcggcccaaggagggagatgatcgccccttcttctggctctttgagaatgtggtggccatgggcgttagtgacaagagggacatcgagacgtcggaagagc

SEQ ID NO: 42124 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtggcggcccaaggagggagatgatcgccccttcttctggctctttgagaatgtggtggccatgggcgttagtgacaagagggacatcgagacgtcggaagagc

SEQ ID NO: 42125 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtggcccaaggagggagatgatcgccccttcttctggctctttgagaatgtggtggccatgggcgttagtgacaagagggacatcgagacgtcggaagagc

SEQ ID NO: 42126 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctggaaggagggagatgatcgccccttcttctggctctttgagaatgtggtggccatgggcgttagtgacaagagggacatcgagacgtcggaagagc

SEQ ID NO: 42127 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtgggagggagatgatcgccccttcttctggctctttgagaatgtggtggccatgggcgttagtgacaagagggacatcgagacgtcggaagagc

SEQ ID NO: 42128 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtggggagatgatcgccccttcttctggctctttgagaatgtggtggccatgggcgttagtgacaagagggacatcgagacgtcggaagagc

SEQ ID NO: 42129 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatgggatgatcgccccttcttctggctctttgagaatgtggtggccatgggcgttagtgacaagagggacatcgagacgtcggaagagc

SEQ ID NO: 42130 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattgggatcgccccttcttctggctctttgagaatgtggtggccatgggcgttagtgacaagagggacatcgagacgtcggaagagc

SEQ ID NO: 42131 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattggcgccccttcttctggctctttgagaatgtggtggccatgggcgttagtgacaagagggacatcgagacgtcggaagagc

SEQ ID NO: 42132 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctggcccttcttctggctctttgagaatgtggtggccatgggcgttagtgacaagagggacatcgagacgtcggaagagc

SEQ ID NO: 42133 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctggttcttctggctctttgagaatgtggtggccatgggcgttagtgacaagagggacatcgagacgtcggaagagc

SEQ ID NO: 42134 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctggttctggctctttgagaatgtggtggccatgggcgttagtgacaagagggacatcgagacgtcggaagagc

SEQ ID NO: 42135 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtggctctttgagaatgtggtggccatgggcgttagtgacaagagggacatcgagacgtcggaagagc

SEQ ID NO: 42136 - RNA, 299 nt, synthetic construct; identical to SEQ ID NO: 42135
  source 1..299: mol_type = other RNA

SEQ ID NO: 42137 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctggtttgagaatgtggtggccatgggcgttagtgacaagagggacatcgagacgtcggaagagc

SEQ ID NO: 42138 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttgggagaatgtggtggccatgggcgttagtgacaagagggacatcgagacgtcggaagagc

SEQ ID NO: 42139 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtggaatgtggtggccatgggcgttagtgacaagagggacatcgagacgtcggaagagc

SEQ ID NO: 42140 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattgggtggtggccatgggcgttagtgacaagagggacatcgagacgtcggaagagc

SEQ ID NO: 42141 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtgggtggccatgggcgttagtgacaagagggacatcgagacgtcggaagagc

SEQ ID NO: 42142 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtgggccatgggcgttagtgacaagagggacatcgagacgtcggaagagc

SEQ ID NO: 42143 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctggatgggcgttagtgacaagagggacatcgagacgtcggaagagc

SEQ ID NO: 42144 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtggggcgttagtgacaagagggacatcgagacgtcggaagagc

SEQ ID NO: 42145 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctgggttagtgacaagagggacatcgagacgtcggaagagc

SEQ ID NO: 42146 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttggagtgacaagagggacatcgagacgtcggaagagc

SEQ ID NO: 42147 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttgggacaagagggacatcgagacgtcggaagagc

SEQ ID NO: 42148 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactggaagagggacatcgagacgtcggaagagc

SEQ ID NO: 42149 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtggagggacatcgagacgtcggaagagc

SEQ ID NO: 42150 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggtgggacatcgagacgtcggaagagc

SEQ ID NO: 42151 - RNA, 299 nt, synthetic construct
  source 1..299: mol_type = other RNA
cgctcttccgcgtctcatgtacgtctgcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42152 - RNA, 299 nt, synthetic construct
  source 1..299: mol_type = other RNA
cgctcttccgcgtctcatgtacgtcgggtgcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42153 - RNA, 299 nt, synthetic construct
  source 1..299: mol_type = other RNA
cgctcttccgcgtctcatgtacgtcggggactgcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42154 - RNA, 299 nt, synthetic construct
  source 1..299: mol_type = other RNA
cgctcttccgcgtctcatgtacgtcggggacgtctgccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42155 - RNA, 299 nt, synthetic construct
  source 1..299: mol_type = other RNA
cgctcttccgcgtctcatgtacgtcggggacgtccgctgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42156 - RNA, 299 nt, synthetic construct
  source 1..299: mol_type = other RNA
cgctcttccgcgtctcatgtacgtcggggacgtccgcagctgcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42157 - RNA, 299 nt, synthetic construct
  source 1..299: mol_type = other RNA
cgctcttccgcgtctcatgtacgtcggggacgtccgcagcgtctgcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42158 - RNA, 299 nt, synthetic construct
  source 1..299: mol_type = other RNA
cgctcttccgcgtctcatgtacgtcggggacgtccgcagcgtcacatgccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42159 - RNA, 299 nt, synthetic construct
  source 1..299: mol_type = other RNA
cgctcttccgcgtctcatgtacgtcggggacgtccgcagcgtcacacagtgcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42160 - RNA, 299 nt, synthetic construct
  source 1..299: mol_type = other RNA
cgctcttccgcgtctcatgtacgtcggggacgtccgcagcgtcacacagaagtgccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42161 - RNA, 299 nt, synthetic construct
  source 1..299: mol_type = other RNA
cgctcttccgcgtctcatgtacgtcggggacgtccgcagcgtcacacagaagcattgcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42162 - RNA, 299 nt, synthetic construct
  source 1..299: mol_type = other RNA
cgctcttccgcgtctcatgtacgtcggggacgtccgcagcgtcacacagaagcatatctgccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42163 - RNA, 299 nt, synthetic construct
  source 1..299: mol_type = other RNA
cgctcttccgcgtctcatgtacgtcggggacgtccgcagcgtcacacagaagcatatccagtgcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42164 - RNA, 299 nt, synthetic construct
  source 1..299: mol_type = other RNA
cgctcttccgcgtctcatgtacgtcggggacgtccgcagcgtcacacagaagcatatccaggagtgctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42165 - RNA, 299 nt, synthetic construct
  source 1..299: mol_type = other RNA
cgctcttccgcgtctcatgtacgtcggggacgtccgcagcgtcacacagaagcatatccaggagtggtgcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42166 - RNA, 299 nt, synthetic construct
  source 1..299: mol_type = other RNA
cgctcttccgcgtctcatgtacgtcggggacgtccgcagcgtcacacagaagcatatccaggagtggggctgcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42167 - RNA, 299 nt, synthetic construct
  source 1..299: mol_type = other RNA
cgctcttccgcgtctcatgtacgtcggggacgtccgcagcgtcacacagaagcatatccaggagtggggcccatgcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42168 - RNA, 299 nt, synthetic construct
  source 1..299: mol_type = other RNA
cgctcttccgcgtctcatgtacgtcggggacgtccgcagcgtcacacagaagcatatccaggagtggggcccattctgcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42169 - RNA, 299 nt, synthetic construct
  source 1..299: mol_type = other RNA
cgctcttccgcgtctcatgtacgtcggggacgtccgcagcgtcacacagaagcatatccaggagtggggcccattcgactgcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42170 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgtgcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42171 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgtgcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42172 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatttgcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42173 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggatgcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42174 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggctgcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42175 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagttgcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42176 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42177 - RNA, 299 nt, synthetic construct; identical to SEQ ID NO: 42176
  source 1..299: mol_type = other RNA

SEQ ID NO: 42178 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaactgcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42179 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgactgcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42180 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctgctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42181 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcctgcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42182 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatttgcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42183 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctgcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42184 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactgccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42185 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttgcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42186 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctgccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42187 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42188 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtgcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42189 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatgcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42190 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttgctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42191 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattgcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42192 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtgcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42193 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttgcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42194 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttgcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42195 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctgccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42196 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42197 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctgcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42198 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctgctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42199 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttgcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42200 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtgcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42201 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctgctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42202 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactgccgcctcctgcatgatgcgcggcccaaggagggagatgatcgccccttcttctggctctttgagaatgtggtggccatgggcgttagtgacaagagggacatcgagacgtcggaagagc

SEQ ID NO: 42203 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctgcctcctgcatgatgcgcggcccaaggagggagatgatcgccccttcttctggctctttgagaatgtggtggccatgggcgttagtgacaagagggacatcgagacgtcggaagagc

SEQ ID NO: 42204 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctgcctgcatgatgcgcggcccaaggagggagatgatcgccccttcttctggctctttgagaatgtggtggccatgggcgttagtgacaagagggacatcgagacgtcggaagagc

SEQ ID NO: 42205 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtgccatgatgcgcggcccaaggagggagatgatcgccccttcttctggctctttgagaatgtggtggccatgggcgttagtgacaagagggacatcgagacgtcggaagagc

SEQ ID NO: 42206 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattgcgatgcgcggcccaaggagggagatgatcgccccttcttctggctctttgagaatgtggtggccatgggcgttagtgacaagagggacatcgagacgtcggaagagc

SEQ ID NO: 42207 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattgcgcgcggcccaaggagggagatgatcgccccttcttctggctctttgagaatgtggtggccatgggcgttagtgacaagagggacatcgagacgtcggaagagc

SEQ ID NO: 42208 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtgccggcccaaggagggagatgatcgccccttcttctggctctttgagaatgtggtggccatgggcgttagtgacaagagggacatcgagacgtcggaagagc

SEQ ID NO: 42209 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtgccccaaggagggagatgatcgccccttcttctggctctttgagaatgtggtggccatgggcgttagtgacaagagggacatcgagacgtcggaagagc

SEQ ID NO: 42210 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctgcaaggagggagatgatcgccccttcttctggctctttgagaatgtggtggccatgggcgttagtgacaagagggacatcgagacgtcggaagagc

SEQ ID NO: 42211 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtgcgagggagatgatcgccccttcttctggctctttgagaatgtggtggccatgggcgttagtgacaagagggacatcgagacgtcggaagagc

SEQ ID NO: 42212 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtgcggagatgatcgccccttcttctggctctttgagaatgtggtggccatgggcgttagtgacaagagggacatcgagacgtcggaagagc

SEQ ID NO: 42213 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatgcgatgatcgccccttcttctggctctttgagaatgtggtggccatgggcgttagtgacaagagggacatcgagacgtcggaagagc

SEQ ID NO: 42214 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattgcgatcgccccttcttctggctctttgagaatgtggtggccatgggcgttagtgacaagagggacatcgagacgtcggaagagc

SEQ ID NO: 42215 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattgccgccccttcttctggctctttgagaatgtggtggccatgggcgttagtgacaagagggacatcgagacgtcggaagagc

SEQ ID NO: 42216 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctgccccttcttctggctctttgagaatgtggtggccatgggcgttagtgacaagagggacatcgagacgtcggaagagc

SEQ ID NO: 42217 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctgcttcttctggctctttgagaatgtggtggccatgggcgttagtgacaagagggacatcgagacgtcggaagagc

SEQ ID NO: 42218 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctgcttctggctctttgagaatgtggtggccatgggcgttagtgacaagagggacatcgagacgtcggaagagc

SEQ ID NO: 42219 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgctggctctttgagaatgtggtggccatgggcgttagtgacaagagggacatcgagacgtcggaagagc

SEQ ID NO: 42220 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtgcctctttgagaatgtggtggccatgggcgttagtgacaagagggacatcgagacgtcggaagagc

SEQ ID NO: 42221 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctgctttgagaatgtggtggccatgggcgttagtgacaagagggacatcgagacgtcggaagagc

SEQ ID NO: 42222 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttgcgagaatgtggtggccatgggcgttagtgacaagagggacatcgagacgtcggaagagc

SEQ ID NO: 42223 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtgcaatgtggtggccatgggcgttagtgacaagagggacatcgagacgtcggaagagc

SEQ ID NO: 42224 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattgcgtggtggccatgggcgttagtgacaagagggacatcgagacgtcggaagagc

SEQ ID NO: 42225 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtgcgtggccatgggcgttagtgacaagagggacatcgagacgtcggaagagc

SEQ ID NO: 42226 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtgcgccatgggcgttagtgacaagagggacatcgagacgtcggaagagc

SEQ ID NO: 42227 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctgcatgggcgttagtgacaagagggacatcgagacgtcggaagagc

SEQ ID NO: 42228 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtgcggcgttagtgacaagagggacatcgagacgtcggaagagc

SEQ ID NO: 42229 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctgcgttagtgacaagagggacatcgagacgtcggaagagc

SEQ ID NO: 42230 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttgcagtgacaagagggacatcgagacgtcggaagagc

SEQ ID NO: 42231 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttgcgacaagagggacatcgagacgtcggaagagc

SEQ ID NO: 42232 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactgcaagagggacatcgagacgtcggaagagc

SEQ ID NO: 42233 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtgcagggacatcgagacgtcggaagagc

SEQ ID NO: 42234 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggtgcgacatcgagacgtcggaagagc

SEQ ID NO: 42235 - RNA, 299 nt, synthetic construct
  source 1..299: mol_type = other RNA
cgctcttccgcgtctcatgtacgtctcgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42236 - RNA, 299 nt, synthetic construct
  source 1..299: mol_type = other RNA
cgctcttccgcgtctcatgtacgtcgggtcggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42237 - RNA, 299 nt, synthetic construct
  source 1..299: mol_type = other RNA
cgctcttccgcgtctcatgtacgtcggggactcggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42238 - RNA, 299 nt, synthetic construct
  source 1..299: mol_type = other RNA
cgctcttccgcgtctcatgtacgtcggggacgtctcgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42239 - RNA, 299 nt, synthetic construct
  source 1..299: mol_type = other RNA
cgctcttccgcgtctcatgtacgtcggggacgtccgctcgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42240 - RNA, 299 nt, synthetic construct
  source 1..299: mol_type = other RNA
cgctcttccgcgtctcatgtacgtcggggacgtccgcagctcggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42241 - RNA, 299 nt, synthetic construct
  source 1..299: mol_type = other RNA
cgctcttccgcgtctcatgtacgtcggggacgtccgcagcgtctcgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42242 - RNA, 299 nt, synthetic construct
  source 1..299: mol_type = other RNA
cgctcttccgcgtctcatgtacgtcggggacgtccgcagcgtcacatcgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42243 - RNA, 299 nt, synthetic construct
  source 1..299: mol_type = other RNA
cgctcttccgcgtctcatgtacgtcggggacgtccgcagcgtcacacagtcgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42244 - RNA, 299 nt, synthetic construct
  source 1..299: mol_type = other RNA
cgctcttccgcgtctcatgtacgtcggggacgtccgcagcgtcacacagaagtcgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42245 - RNA, 299 nt, synthetic construct
  source 1..299: mol_type = other RNA
cgctcttccgcgtctcatgtacgtcggggacgtccgcagcgtcacacagaagcattcgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42246 - RNA, 299 nt, synthetic construct
  source 1..299: mol_type = other RNA
cgctcttccgcgtctcatgtacgtcggggacgtccgcagcgtcacacagaagcatatctcgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42247 - RNA, 299 nt, synthetic construct
  source 1..299: mol_type = other RNA
cgctcttccgcgtctcatgtacgtcggggacgtccgcagcgtcacacagaagcatatccagtcggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42248 - RNA, 299 nt, synthetic construct
  source 1..299: mol_type = other RNA
cgctcttccgcgtctcatgtacgtcggggacgtccgcagcgtcacacagaagcatatccaggagtcgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42249 - RNA, 299 nt, synthetic construct
  source 1..299: mol_type = other RNA
cgctcttccgcgtctcatgtacgtcggggacgtccgcagcgtcacacagaagcatatccaggagtggtcgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42250 - RNA, 299 nt, synthetic construct
  source 1..299: mol_type = other RNA
cgctcttccgcgtctcatgtacgtcggggacgtccgcagcgtcacacagaagcatatccaggagtggggctcgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42251 - RNA, 299 nt, synthetic construct
  source 1..299: mol_type = other RNA
cgctcttccgcgtctcatgtacgtcggggacgtccgcagcgtcacacagaagcatatccaggagtggggcccatcgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42252 - RNA, 299 nt, synthetic construct
  source 1..299: mol_type = other RNA
cgctcttccgcgtctcatgtacgtcggggacgtccgcagcgtcacacagaagcatatccaggagtggggcccattctcggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42253 - RNA, 299 nt, synthetic construct
  source 1..299: mol_type = other RNA
cgctcttccgcgtctcatgtacgtcggggacgtccgcagcgtcacacagaagcatatccaggagtggggcccattcgactcgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42254 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgtcggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42255 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgtcgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42256 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatttcgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42257 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggatcgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42258 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggctcgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42259 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagttcgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42260 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctcgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42261 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgctcgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42262 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaactcggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42263 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgactcgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42264 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42265 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcctcgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42266 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatttcggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42267 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctcgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42268 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactcgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42269 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttcggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42270 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctcgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42271 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctcgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42272 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtcgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42273 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatcgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42274 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttcgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42275 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattcggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42276 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtcgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42277 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttcgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42278 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttcgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42279 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctcgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42280 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctcgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42281 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctcgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42282 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctcgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42283 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttcggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42284 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtcgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42285 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctcgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42286 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactcgcgcctcctgcatgatgcgcggcccaaggagggagatgatcgccccttcttctggctctttgagaatgtggtggccatgggcgttagtgacaagagggacatcgagacgtcggaagagc

SEQ ID NO: 42287 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctcgctcctgcatgatgcgcggcccaaggagggagatgatcgccccttcttctggctctttgagaatgtggtggccatgggcgttagtgacaagagggacatcgagacgtcggaagagc

SEQ ID NO: 42288 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctcgctgcatgatgcgcggcccaaggagggagatgatcgccccttcttctggctctttgagaatgtggtggccatgggcgttagtgacaagagggacatcgagacgtcggaagagc

SEQ ID NO: 42289 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtcgcatgatgcgcggcccaaggagggagatgatcgccccttcttctggctctttgagaatgtggtggccatgggcgttagtgacaagagggacatcgagacgtcggaagagc

SEQ ID NO: 42290 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattcggatgcgcggcccaaggagggagatgatcgccccttcttctggctctttgagaatgtggtggccatgggcgttagtgacaagagggacatcgagacgtcggaagagc

SEQ ID NO: 42291 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattcggcgcggcccaaggagggagatgatcgccccttcttctggctctttgagaatgtggtggccatgggcgttagtgacaagagggacatcgagacgtcggaagagc

SEQ ID NO: 42292 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtcgcggcccaaggagggagatgatcgccccttcttctggctctttgagaatgtggtggccatgggcgttagtgacaagagggacatcgagacgtcggaagagc

SEQ ID NO: 42293 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtcgcccaaggagggagatgatcgccccttcttctggctctttgagaatgtggtggccatgggcgttagtgacaagagggacatcgagacgtcggaagagc

SEQ ID NO: 42294 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctcgaaggagggagatgatcgccccttcttctggctctttgagaatgtggtggccatgggcgttagtgacaagagggacatcgagacgtcggaagagc

SEQ ID NO: 42295 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtcggagggagatgatcgccccttcttctggctctttgagaatgtggtggccatgggcgttagtgacaagagggacatcgagacgtcggaagagc

SEQ ID NO: 42296 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtcgggagatgatcgccccttcttctggctctttgagaatgtggtggccatgggcgttagtgacaagagggacatcgagacgtcggaagagc

SEQ ID NO: 42297 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatcggatgatcgccccttcttctggctctttgagaatgtggtggccatgggcgttagtgacaagagggacatcgagacgtcggaagagc

SEQ ID NO: 42298 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattcggatcgccccttcttctggctctttgagaatgtggtggccatgggcgttagtgacaagagggacatcgagacgtcggaagagc

SEQ ID NO: 42299 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattcgcgccccttcttctggctctttgagaatgtggtggccatgggcgttagtgacaagagggacatcgagacgtcggaagagc

SEQ ID NO: 42300 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctcgcccttcttctggctctttgagaatgtggtggccatgggcgttagtgacaagagggacatcgagacgtcggaagagc

SEQ ID NO: 42301 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctcgttcttctggctctttgagaatgtggtggccatgggcgttagtgacaagagggacatcgagacgtcggaagagc

SEQ ID NO: 42302 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctcgttctggctctttgagaatgtggtggccatgggcgttagtgacaagagggacatcgagacgtcggaagagc

SEQ ID NO: 42303 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctcgtggctctttgagaatgtggtggccatgggcgttagtgacaagagggacatcgagacgtcggaagagc

SEQ ID NO: 42304 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtcgctctttgagaatgtggtggccatgggcgttagtgacaagagggacatcgagacgtcggaagagc

SEQ ID NO: 42305 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctcgtttgagaatgtggtggccatgggcgttagtgacaagagggacatcgagacgtcggaagagc

SEQ ID NO: 42306 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttcggagaatgtggtggccatgggcgttagtgacaagagggacatcgagacgtcggaagagc

SEQ ID NO: 42307 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtcgaatgtggtggccatgggcgttagtgacaagagggacatcgagacgtcggaagagc

SEQ ID NO: 42308 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattcggtggtggccatgggcgttagtgacaagagggacatcgagacgtcggaagagc

SEQ ID NO: 42309 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtcggtggccatgggcgttagtgacaagagggacatcgagacgtcggaagagc

SEQ ID NO: 42310 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtcggccatgggcgttagtgacaagagggacatcgagacgtcggaagagc

SEQ ID NO: 42311 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctcgatgggcgttagtgacaagagggacatcgagacgtcggaagagc

SEQ ID NO: 42312 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtcgggcgttagtgacaagagggacatcgagacgtcggaagagc

SEQ ID NO: 42313 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctcggttagtgacaagagggacatcgagacgtcggaagagc

SEQ ID NO: 42314 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttcgagtgacaagagggacatcgagacgtcggaagagc

SEQ ID NO: 42315 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttcggacaagagggacatcgagacgtcggaagagc

SEQ ID NO: 42316 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactcgaagagggacatcgagacgtcggaagagc

SEQ ID NO: 42317 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtcgagggacatcgagacgtcggaagagc

SEQ ID NO: 42318 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggtcggacatcgagacgtcggaagagc

SEQ ID NO: 42319 - RNA, 299 nt, synthetic construct
  source 1..299: mol_type = other RNA
cgctcttccgcgtctcatgtacgtctccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42320 - RNA, 299 nt, synthetic construct
  source 1..299: mol_type = other RNA
cgctcttccgcgtctcatgtacgtcgggtccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42321 - RNA, 299 nt, synthetic construct
  source 1..299: mol_type = other RNA
cgctcttccgcgtctcatgtacgtcggggactccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42322 - RNA, 299 nt, synthetic construct
  source 1..299: mol_type = other RNA
cgctcttccgcgtctcatgtacgtcggggacgtctcccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42323 - RNA, 299 nt, synthetic construct
  source 1..299: mol_type = other RNA
cgctcttccgcgtctcatgtacgtcggggacgtccgctccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42324 - RNA, 299 nt, synthetic construct
  source 1..299: mol_type = other RNA
cgctcttccgcgtctcatgtacgtcggggacgtccgcagctccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42325 - RNA, 299 nt, synthetic construct
  source 1..299: mol_type = other RNA
cgctcttccgcgtctcatgtacgtcggggacgtccgcagcgtctccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42326 - RNA, 299 nt, synthetic construct
  source 1..299: mol_type = other RNA
cgctcttccgcgtctcatgtacgtcggggacgtccgcagcgtcacatcccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42327 - RNA, 299 nt, synthetic construct
  source 1..299: mol_type = other RNA
cgctcttccgcgtctcatgtacgtcggggacgtccgcagcgtcacacagtccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42328 - RNA, 299 nt, synthetic construct
  source 1..299: mol_type = other RNA
cgctcttccgcgtctcatgtacgtcggggacgtccgcagcgtcacacagaagtcccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42329 - RNA, 299 nt, synthetic construct
  source 1..299: mol_type = other RNA
cgctcttccgcgtctcatgtacgtcggggacgtccgcagcgtcacacagaagcattccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42330 - RNA, 299 nt, synthetic construct
  source 1..299: mol_type = other RNA
cgctcttccgcgtctcatgtacgtcggggacgtccgcagcgtcacacagaagcatatctcccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42331 - RNA, 299 nt, synthetic construct
  source 1..299: mol_type = other RNA
cgctcttccgcgtctcatgtacgtcggggacgtccgcagcgtcacacagaagcatatccagtccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42332 - RNA, 299 nt, synthetic construct
  source 1..299: mol_type = other RNA
cgctcttccgcgtctcatgtacgtcggggacgtccgcagcgtcacacagaagcatatccaggagtcctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42333 - RNA, 299 nt, synthetic construct
  source 1..299: mol_type = other RNA
cgctcttccgcgtctcatgtacgtcggggacgtccgcagcgtcacacagaagcatatccaggagtggtccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42334 - RNA, 299 nt, synthetic construct
  source 1..299: mol_type = other RNA
cgctcttccgcgtctcatgtacgtcggggacgtccgcagcgtcacacagaagcatatccaggagtggggctccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42335 - RNA, 299 nt, synthetic construct
  source 1..299: mol_type = other RNA
cgctcttccgcgtctcatgtacgtcggggacgtccgcagcgtcacacagaagcatatccaggagtggggcccatccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42336 - RNA, 299 nt, synthetic construct
  source 1..299: mol_type = other RNA
cgctcttccgcgtctcatgtacgtcggggacgtccgcagcgtcacacagaagcatatccaggagtggggcccattctccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42337 - RNA, 299 nt, synthetic construct
  source 1..299: mol_type = other RNA
cgctcttccgcgtctcatgtacgtcggggacgtccgcagcgtcacacagaagcatatccaggagtggggcccattcgactccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42338 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgtccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42339 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgtccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42340 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgatttccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42341 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggatccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42342 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggctccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42343 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagttccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42344 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctcctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42345 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgctccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42346 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaactccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42347 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgactccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42348 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42349 - RNA, 299 nt, synthetic construct; identical to SEQ ID NO: 42348
  source 1..299: mol_type = other RNA

SEQ ID NO: 42350 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccatttccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42351 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtctccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42352 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaactcccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42353 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccttccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42354 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcctcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42355 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgctccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42356 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagtccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42357 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42358 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttcctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42359 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttattccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42360 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagtccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42361 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggttccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42362 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtacttccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42363 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggctcccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42364 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgctccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42365 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42366 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctcctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42367 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcttttccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42368 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42369 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctcctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42370 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctactcccgcctcctgcatgatgcgcggcccaaggagggagatgatcgccccttcttctggctctttgagaatgtggtggccatgggcgttagtgacaagagggacatcgagacgtcggaagagc

SEQ ID NO: 42371 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgctccctcctgcatgatgcgcggcccaaggagggagatgatcgccccttcttctggctctttgagaatgtggtggccatgggcgttagtgacaagagggacatcgagacgtcggaagagc

SEQ ID NO: 42372 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctctccctgcatgatgcgcggcccaaggagggagatgatcgccccttcttctggctctttgagaatgtggtggccatgggcgttagtgacaagagggacatcgagacgtcggaagagc

SEQ ID NO: 42373 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgtcccatgatgcgcggcccaaggagggagatgatcgccccttcttctggctctttgagaatgtggtggccatgggcgttagtgacaagagggacatcgagacgtcggaagagc

SEQ ID NO: 42374 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcattccgatgcgcggcccaaggagggagatgatcgccccttcttctggctctttgagaatgtggtggccatgggcgttagtgacaagagggacatcgagacgtcggaagagc

SEQ ID NO: 42375 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgattccgcgcggcccaaggagggagatgatcgccccttcttctggctctttgagaatgtggtggccatgggcgttagtgacaagagggacatcgagacgtcggaagagc

SEQ ID NO: 42376 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgtcccggcccaaggagggagatgatcgccccttcttctggctctttgagaatgtggtggccatgggcgttagtgacaagagggacatcgagacgtcggaagagc

SEQ ID NO: 42377 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggtcccccaaggagggagatgatcgccccttcttctggctctttgagaatgtggtggccatgggcgttagtgacaagagggacatcgagacgtcggaagagc

SEQ ID NO: 42378 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccctccaaggagggagatgatcgccccttcttctggctctttgagaatgtggtggccatgggcgttagtgacaagagggacatcgagacgtcggaagagc

SEQ ID NO: 42379 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagtccgagggagatgatcgccccttcttctggctctttgagaatgtggtggccatgggcgttagtgacaagagggacatcgagacgtcggaagagc

SEQ ID NO: 42380 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagtccggagatgatcgccccttcttctggctctttgagaatgtggtggccatgggcgttagtgacaagagggacatcgagacgtcggaagagc

SEQ ID NO: 42381 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggatccgatgatcgccccttcttctggctctttgagaatgtggtggccatgggcgttagtgacaagagggacatcgagacgtcggaagagc

SEQ ID NO: 42382 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagattccgatcgccccttcttctggctctttgagaatgtggtggccatgggcgttagtgacaagagggacatcgagacgtcggaagagc

SEQ ID NO: 42383 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgattcccgccccttcttctggctctttgagaatgtggtggccatgggcgttagtgacaagagggacatcgagacgtcggaagagc

SEQ ID NO: 42384 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgctcccccttcttctggctctttgagaatgtggtggccatgggcgttagtgacaagagggacatcgagacgtcggaagagc

SEQ ID NO: 42385 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccctccttcttctggctctttgagaatgtggtggccatgggcgttagtgacaagagggacatcgagacgtcggaagagc

SEQ ID NO: 42386 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctccttctggctctttgagaatgtggtggccatgggcgttagtgacaagagggacatcgagacgtcggaagagc

SEQ ID NO: 42387 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctcctggctctttgagaatgtggtggccatgggcgttagtgacaagagggacatcgagacgtcggaagagc

SEQ ID NO: 42388 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtccctctttgagaatgtggtggccatgggcgttagtgacaagagggacatcgagacgtcggaagagc

SEQ ID NO: 42389 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctcctttgagaatgtggtggccatgggcgttagtgacaagagggacatcgagacgtcggaagagc

SEQ ID NO: 42390 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcttttccgagaatgtggtggccatgggcgttagtgacaagagggacatcgagacgtcggaagagc

SEQ ID NO: 42391 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagtccaatgtggtggccatgggcgttagtgacaagagggacatcgagacgtcggaagagc

SEQ ID NO: 42392 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaattccgtggtggccatgggcgttagtgacaagagggacatcgagacgtcggaagagc

SEQ ID NO: 42393 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgtccgtggccatgggcgttagtgacaagagggacatcgagacgtcggaagagc

SEQ ID NO: 42394 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgtccgccatgggcgttagtgacaagagggacatcgagacgtcggaagagc

SEQ ID NO: 42395 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcctccatgggcgttagtgacaagagggacatcgagacgtcggaagagc

SEQ ID NO: 42396 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgtccggcgttagtgacaagagggacatcgagacgtcggaagagc

SEQ ID NO: 42397 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggctccgttagtgacaagagggacatcgagacgtcggaagagc

SEQ ID NO: 42398 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtttccagtgacaagagggacatcgagacgtcggaagagc

SEQ ID NO: 42399 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagttccgacaagagggacatcgagacgtcggaagagc

SEQ ID NO: 42400 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgactccaagagggacatcgagacgtcggaagagc

SEQ ID NO: 42401 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagtccagggacatcgagacgtcggaagagc

SEQ ID NO: 42402 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggtccgacatcgagacgtcggaagagc

SEQ ID NO: 42403 - RNA, 299 nt, synthetic construct
  source 1..299: mol_type = other RNA
cgctcttccgcgtctcatgtacgtcgagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42404 - RNA, 299 nt, synthetic construct
  source 1..299: mol_type = other RNA
cgctcttccgcgtctcatgtacgtcggggaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42405 - RNA, 299 nt, synthetic construct
  source 1..299: mol_type = other RNA
cgctcttccgcgtctcatgtacgtcggggacgaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42406 - RNA, 299 nt, synthetic construct
  source 1..299: mol_type = other RNA
cgctcttccgcgtctcatgtacgtcggggacgtcgagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42407 - RNA, 299 nt, synthetic construct
  source 1..299: mol_type = other RNA
cgctcttccgcgtctcatgtacgtcggggacgtccgcgagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42408 - RNA, 299 nt, synthetic construct
  source 1..299: mol_type = other RNA
cgctcttccgcgtctcatgtacgtcggggacgtccgcagcgaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42409 - RNA, 299 nt, synthetic construct
  source 1..299: mol_type = other RNA
cgctcttccgcgtctcatgtacgtcggggacgtccgcagcgtcgagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42410 - RNA, 299 nt, synthetic construct
  source 1..299: mol_type = other RNA
cgctcttccgcgtctcatgtacgtcggggacgtccgcagcgtcacagagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42411 - RNA, 299 nt, synthetic construct
  source 1..299: mol_type = other RNA
cgctcttccgcgtctcatgtacgtcggggacgtccgcagcgtcacacaggagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42412 - RNA, 299 nt, synthetic construct
  source 1..299: mol_type = other RNA
cgctcttccgcgtctcatgtacgtcggggacgtccgcagcgtcacacagaaggagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42413 - RNA, 299 nt, synthetic construct
  source 1..299: mol_type = other RNA
cgctcttccgcgtctcatgtacgtcggggacgtccgcagcgtcacacagaagcatgagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42414 - RNA, 299 nt, synthetic construct
  source 1..299: mol_type = other RNA
cgctcttccgcgtctcatgtacgtcggggacgtccgcagcgtcacacagaagcatatcgagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42415 - RNA, 299 nt, synthetic construct
  source 1..299: mol_type = other RNA
cgctcttccgcgtctcatgtacgtcggggacgtccgcagcgtcacacagaagcatatccaggaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42416 - RNA, 299 nt, synthetic construct; identical to SEQ ID NO: 42415
  source 1..299: mol_type = other RNA

SEQ ID NO: 42417 - RNA, 299 nt, synthetic construct
  source 1..299: mol_type = other RNA
cgctcttccgcgtctcatgtacgtcggggacgtccgcagcgtcacacagaagcatatccaggagtgggagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42418 - RNA, 299 nt, synthetic construct
  source 1..299: mol_type = other RNA
cgctcttccgcgtctcatgtacgtcggggacgtccgcagcgtcacacagaagcatatccaggagtggggcgagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42419 - RNA, 299 nt, synthetic construct
  source 1..299: mol_type = other RNA
cgctcttccgcgtctcatgtacgtcggggacgtccgcagcgtcacacagaagcatatccaggagtggggcccagagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42420 - RNA, 299 nt, synthetic construct
  source 1..299: mol_type = other RNA
cgctcttccgcgtctcatgtacgtcggggacgtccgcagcgtcacacagaagcatatccaggagtggggcccattcgaggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42421 - RNA, 299 nt, synthetic construct
  source 1..299: mol_type = other RNA
cgctcttccgcgtctcatgtacgtcggggacgtccgcagcgtcacacagaagcatatccaggagtggggcccattcgacgagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42422 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42423 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtggagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42424 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattgagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42425 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggagagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42426 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcgagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42427 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtgagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42428 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccgagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42429 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcgagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42430 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42431 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacgagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42432 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcgagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42433 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccgagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42434 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42435 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42436 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42437 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42438 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42439 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42440 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42441 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42442 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42443 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42444 - RNA, 299 nt, synthetic construct; identical to SEQ ID NO: 42443
  source 1..299: mol_type = other RNA

SEQ ID NO: 42445 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42446 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42447 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42448 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42449 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42450 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42451 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42452 - RNA, 299 nt, synthetic construct; identical to SEQ ID NO: 42451
  source 1..299: mol_type = other RNA

SEQ ID NO: 42453 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42454 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgagcgcctcctgcatgatgcgcggcccaaggagggagatgatcgccccttcttctggctctttgagaatgtggtggccatgggcgttagtgacaagagggacatcgagacgtcggaagagc

SEQ ID NO: 42455 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgagctcctgcatgatgcgcggcccaaggagggagatgatcgccccttcttctggctctttgagaatgtggtggccatgggcgttagtgacaagagggacatcgagacgtcggaagagc

SEQ ID NO: 42456 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgagctgcatgatgcgcggcccaaggagggagatgatcgccccttcttctggctctttgagaatgtggtggccatgggcgttagtgacaagagggacatcgagacgtcggaagagc

SEQ ID NO: 42457 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggagcatgatgcgcggcccaaggagggagatgatcgccccttcttctggctctttgagaatgtggtggccatgggcgttagtgacaagagggacatcgagacgtcggaagagc

SEQ ID NO: 42458 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgaggatgcgcggcccaaggagggagatgatcgccccttcttctggctctttgagaatgtggtggccatgggcgttagtgacaagagggacatcgagacgtcggaagagc

SEQ ID NO: 42459 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgaggcgcggcccaaggagggagatgatcgccccttcttctggctctttgagaatgtggtggccatgggcgttagtgacaagagggacatcgagacgtcggaagagc

SEQ ID NO: 42460 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggagcggcccaaggagggagatgatcgccccttcttctggctctttgagaatgtggtggccatgggcgttagtgacaagagggacatcgagacgtcggaagagc

SEQ ID NO: 42461 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggagcccaaggagggagatgatcgccccttcttctggctctttgagaatgtggtggccatgggcgttagtgacaagagggacatcgagacgtcggaagagc

SEQ ID NO: 42462 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgagaaggagggagatgatcgccccttcttctggctctttgagaatgtggtggccatgggcgttagtgacaagagggacatcgagacgtcggaagagc

SEQ ID NO: 42463 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggagggagatgatcgccccttcttctggctctttgagaatgtggtggccatgggcgttagtgacaagagggacatcgagacgtcggaagagc

SEQ ID NO: 42464 - RNA, 299 nt, synthetic construct; identical to SEQ ID NO: 42463
  source 1..299: mol_type = other RNA

SEQ ID NO: 42465 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagaggatgatcgccccttcttctggctctttgagaatgtggtggccatgggcgttagtgacaagagggacatcgagacgtcggaagagc

SEQ ID NO: 42466 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgaggatcgccccttcttctggctctttgagaatgtggtggccatgggcgttagtgacaagagggacatcgagacgtcggaagagc

SEQ ID NO: 42467 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgagcgccccttcttctggctctttgagaatgtggtggccatgggcgttagtgacaagagggacatcgagacgtcggaagagc

SEQ ID NO: 42468 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgagcccttcttctggctctttgagaatgtggtggccatgggcgttagtgacaagagggacatcgagacgtcggaagagc

SEQ ID NO: 42469 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgagttcttctggctctttgagaatgtggtggccatgggcgttagtgacaagagggacatcgagacgtcggaagagc

SEQ ID NO: 42470 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgagttctggctctttgagaatgtggtggccatgggcgttagtgacaagagggacatcgagacgtcggaagagc

SEQ ID NO: 42471 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgagtggctctttgagaatgtggtggccatgggcgttagtgacaagagggacatcgagacgtcggaagagc

SEQ ID NO: 42472 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggagctctttgagaatgtggtggccatgggcgttagtgacaagagggacatcgagacgtcggaagagc

SEQ ID NO: 42473 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgagtttgagaatgtggtggccatgggcgttagtgacaagagggacatcgagacgtcggaagagc

SEQ ID NO: 42474 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggagaatgtggtggccatgggcgttagtgacaagagggacatcgagacgtcggaagagc

SEQ ID NO: 42475 - RNA, 299 nt, synthetic construct; identical to SEQ ID NO: 42474
  source 1..299: mol_type = other RNA

SEQ ID NO: 42476 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgaggtggtggccatgggcgttagtgacaagagggacatcgagacgtcggaagagc

SEQ ID NO: 42477 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggaggtggccatgggcgttagtgacaagagggacatcgagacgtcggaagagc

SEQ ID NO: 42478 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggaggccatgggcgttagtgacaagagggacatcgagacgtcggaagagc

SEQ ID NO: 42479 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgagatgggcgttagtgacaagagggacatcgagacgtcggaagagc

SEQ ID NO: 42480 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggagggcgttagtgacaagagggacatcgagacgtcggaagagc

SEQ ID NO: 42481 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgaggttagtgacaagagggacatcgagacgtcggaagagc

SEQ ID NO: 42482 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgagagtgacaagagggacatcgagacgtcggaagagc

SEQ ID NO: 42483 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaggacaagagggacatcgagacgtcggaagagc

SEQ ID NO: 42484 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgagaagagggacatcgagacgtcggaagagc

SEQ ID NO: 42485 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggagagggacatcgagacgtcggaagagc

SEQ ID NO: 42486 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggaggacatcgagacgtcggaagagc

SEQ ID NO: 42487 - RNA, 299 nt, synthetic construct
  source 1..299: mol_type = other RNA
cgctcttccgcgtctcatgtacgtcgacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42488 - RNA, 299 nt, synthetic construct
  source 1..299: mol_type = other RNA
cgctcttccgcgtctcatgtacgtcggggacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42489 - RNA, 299 nt, synthetic construct; identical to SEQ ID NO: 42488
  source 1..299: mol_type = other RNA

SEQ ID NO: 42490 - RNA, 299 nt, synthetic construct
  source 1..299: mol_type = other RNA
cgctcttccgcgtctcatgtacgtcggggacgtcgaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42491 - RNA, 299 nt, synthetic construct
  source 1..299: mol_type = other RNA
cgctcttccgcgtctcatgtacgtcggggacgtccgcgacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42492 - RNA, 299 nt, synthetic construct
  source 1..299: mol_type = other RNA
cgctcttccgcgtctcatgtacgtcggggacgtccgcagcgacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42493 - RNA, 299 nt, synthetic construct
  source 1..299: mol_type = other RNA
cgctcttccgcgtctcatgtacgtcggggacgtccgcagcgtcgacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42494 - RNA, 299 nt, synthetic construct
  source 1..299: mol_type = other RNA
cgctcttccgcgtctcatgtacgtcggggacgtccgcagcgtcacagaccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42495 - RNA, 299 nt, synthetic construct
  source 1..299: mol_type = other RNA
cgctcttccgcgtctcatgtacgtcggggacgtccgcagcgtcacacaggacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42496 - RNA, 299 nt, synthetic construct
  source 1..299: mol_type = other RNA
cgctcttccgcgtctcatgtacgtcggggacgtccgcagcgtcacacagaaggaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42497 - RNA, 299 nt, synthetic construct
  source 1..299: mol_type = other RNA
cgctcttccgcgtctcatgtacgtcggggacgtccgcagcgtcacacagaagcatgacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42498 - RNA, 299 nt, synthetic construct
  source 1..299: mol_type = other RNA
cgctcttccgcgtctcatgtacgtcggggacgtccgcagcgtcacacagaagcatatcgaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42499 - RNA, 299 nt, synthetic construct
  source 1..299: mol_type = other RNA
cgctcttccgcgtctcatgtacgtcggggacgtccgcagcgtcacacagaagcatatccaggacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42500 - RNA, 299 nt, synthetic construct
  source 1..299: mol_type = other RNA
cgctcttccgcgtctcatgtacgtcggggacgtccgcagcgtcacacagaagcatatccaggaggactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42501 - RNA, 299 nt, synthetic construct
  source 1..299: mol_type = other RNA
cgctcttccgcgtctcatgtacgtcggggacgtccgcagcgtcacacagaagcatatccaggagtgggacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42502 - RNA, 299 nt, synthetic construct
  source 1..299: mol_type = other RNA
cgctcttccgcgtctcatgtacgtcggggacgtccgcagcgtcacacagaagcatatccaggagtggggcgacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42503 - RNA, 299 nt, synthetic construct
  source 1..299: mol_type = other RNA
cgctcttccgcgtctcatgtacgtcggggacgtccgcagcgtcacacagaagcatatccaggagtggggcccagacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42504 - RNA, 299 nt, synthetic construct
  source 1..299: mol_type = other RNA
cgctcttccgcgtctcatgtacgtcggggacgtccgcagcgtcacacagaagcatatccaggagtggggcccattcgacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42505 - RNA, 299 nt, synthetic construct; identical to SEQ ID NO: 42504
  source 1..299: mol_type = other RNA

SEQ ID NO: 42506 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42507 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtggacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42508 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattgacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42509 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggagacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42510 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcgacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42511 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtgacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42512 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccgactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42513 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcgacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42514 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42515 - RNA, 299 nt, synthetic construct; identical to SEQ ID NO: 42514
  source 1..299: mol_type = other RNA

SEQ ID NO: 42516 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcgactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42517 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccgacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42518 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42519 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42520 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42521 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42522 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42523 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42524 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42525 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42526 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42527 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42528 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42529 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42530 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42531 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42532 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42533 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42534 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42535 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42536 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42537 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42538 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42539 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgacctcctgcatgatgcgcggcccaaggagggagatgatcgccccttcttctggctctttgagaatgtggtggccatgggcgttagtgacaagagggacatcgagacgtcggaagagc

SEQ ID NO: 42540 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgacctgcatgatgcgcggcccaaggagggagatgatcgccccttcttctggctctttgagaatgtggtggccatgggcgttagtgacaagagggacatcgagacgtcggaagagc

SEQ ID NO: 42541 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggaccatgatgcgcggcccaaggagggagatgatcgccccttcttctggctctttgagaatgtggtggccatgggcgttagtgacaagagggacatcgagacgtcggaagagc

SEQ ID NO: 42542 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgacgatgcgcggcccaaggagggagatgatcgccccttcttctggctctttgagaatgtggtggccatgggcgttagtgacaagagggacatcgagacgtcggaagagc

SEQ ID NO: 42543 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgacgcgcggcccaaggagggagatgatcgccccttcttctggctctttgagaatgtggtggccatgggcgttagtgacaagagggacatcgagacgtcggaagagc

SEQ ID NO: 42544 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggaccggcccaaggagggagatgatcgccccttcttctggctctttgagaatgtggtggccatgggcgttagtgacaagagggacatcgagacgtcggaagagc

SEQ ID NO: 42545 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggaccccaaggagggagatgatcgccccttcttctggctctttgagaatgtggtggccatgggcgttagtgacaagagggacatcgagacgtcggaagagc

SEQ ID NO: 42546 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgacaaggagggagatgatcgccccttcttctggctctttgagaatgtggtggccatgggcgttagtgacaagagggacatcgagacgtcggaagagc

SEQ ID NO: 42547 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggacgagggagatgatcgccccttcttctggctctttgagaatgtggtggccatgggcgttagtgacaagagggacatcgagacgtcggaagagc

SEQ ID NO: 42548 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggacggagatgatcgccccttcttctggctctttgagaatgtggtggccatgggcgttagtgacaagagggacatcgagacgtcggaagagc

SEQ ID NO: 42549 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagacgatgatcgccccttcttctggctctttgagaatgtggtggccatgggcgttagtgacaagagggacatcgagacgtcggaagagc

SEQ ID NO: 42550 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgacgatcgccccttcttctggctctttgagaatgtggtggccatgggcgttagtgacaagagggacatcgagacgtcggaagagc

SEQ ID NO: 42551 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgaccgccccttcttctggctctttgagaatgtggtggccatgggcgttagtgacaagagggacatcgagacgtcggaagagc

SEQ ID NO: 42552 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgaccccttcttctggctctttgagaatgtggtggccatgggcgttagtgacaagagggacatcgagacgtcggaagagc

SEQ ID NO: 42553 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgacttcttctggctctttgagaatgtggtggccatgggcgttagtgacaagagggacatcgagacgtcggaagagc

SEQ ID NO: 42554 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgacttctggctctttgagaatgtggtggccatgggcgttagtgacaagagggacatcgagacgtcggaagagc

SEQ ID NO: 42555 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgactggctctttgagaatgtggtggccatgggcgttagtgacaagagggacatcgagacgtcggaagagc

SEQ ID NO: 42556 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggacctctttgagaatgtggtggccatgggcgttagtgacaagagggacatcgagacgtcggaagagc

SEQ ID NO: 42557 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgactttgagaatgtggtggccatgggcgttagtgacaagagggacatcgagacgtcggaagagc

SEQ ID NO: 42558 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgacgagaatgtggtggccatgggcgttagtgacaagagggacatcgagacgtcggaagagc

SEQ ID NO: 42559 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggacaatgtggtggccatgggcgttagtgacaagagggacatcgagacgtcggaagagc

SEQ ID NO: 42560 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgacgtggtggccatgggcgttagtgacaagagggacatcgagacgtcggaagagc

SEQ ID NO: 42561 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggacgtggccatgggcgttagtgacaagagggacatcgagacgtcggaagagc

SEQ ID NO: 42562 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggacgccatgggcgttagtgacaagagggacatcgagacgtcggaagagc

SEQ ID NO: 42563 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgacatgggcgttagtgacaagagggacatcgagacgtcggaagagc

SEQ ID NO: 42564 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggacggcgttagtgacaagagggacatcgagacgtcggaagagc

SEQ ID NO: 42565 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgacgttagtgacaagagggacatcgagacgtcggaagagc

SEQ ID NO: 42566 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgacagtgacaagagggacatcgagacgtcggaagagc

SEQ ID NO: 42567 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgacaagagggacatcgagacgtcggaagagc

SEQ ID NO: 42568 - RNA, 299 nt, synthetic construct; identical to SEQ ID NO: 42567
  source 1..299: mol_type = other RNA

SEQ ID NO: 42569 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggacagggacatcgagacgtcggaagagc

SEQ ID NO: 42570 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacgacatcgagacgtcggaagagc

SEQ ID NO: 42571 - RNA, 299 nt, synthetic construct
  source 1..299: mol_type = other RNA
cgctcttccgcgtctcatgtacgtcgtgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42572 - RNA, 299 nt, synthetic construct
  source 1..299: mol_type = other RNA
cgctcttccgcgtctcatgtacgtcggggtggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42573 - RNA, 299 nt, synthetic construct
  source 1..299: mol_type = other RNA
cgctcttccgcgtctcatgtacgtcggggacgtggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42574 - RNA, 299 nt, synthetic construct
  source 1..299: mol_type = other RNA
cgctcttccgcgtctcatgtacgtcggggacgtcgtgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42575 - RNA, 299 nt, synthetic construct
  source 1..299: mol_type = other RNA
cgctcttccgcgtctcatgtacgtcggggacgtccgcgtgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42576 - RNA, 299 nt, synthetic construct
  source 1..299: mol_type = other RNA
cgctcttccgcgtctcatgtacgtcggggacgtccgcagcgtggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42577 - RNA, 299 nt, synthetic construct
  source 1..299: mol_type = other RNA
cgctcttccgcgtctcatgtacgtcggggacgtccgcagcgtcgtgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42578 - RNA, 299 nt, synthetic construct
  source 1..299: mol_type = other RNA
cgctcttccgcgtctcatgtacgtcggggacgtccgcagcgtcacagtgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42579 - RNA, 299 nt, synthetic construct
  source 1..299: mol_type = other RNA
cgctcttccgcgtctcatgtacgtcggggacgtccgcagcgtcacacaggtgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42580 - RNA, 299 nt, synthetic construct
  source 1..299: mol_type = other RNA
cgctcttccgcgtctcatgtacgtcggggacgtccgcagcgtcacacagaaggtgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42581 - RNA, 299 nt, synthetic construct
  source 1..299: mol_type = other RNA
cgctcttccgcgtctcatgtacgtcggggacgtccgcagcgtcacacagaagcatgtgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42582 - RNA, 299 nt, synthetic construct
  source 1..299: mol_type = other RNA
cgctcttccgcgtctcatgtacgtcggggacgtccgcagcgtcacacagaagcatatcgtgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42583 - RNA, 299 nt, synthetic construct
  source 1..299: mol_type = other RNA
cgctcttccgcgtctcatgtacgtcggggacgtccgcagcgtcacacagaagcatatccaggtggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42584 - RNA, 299 nt, synthetic construct
  source 1..299: mol_type = other RNA
cgctcttccgcgtctcatgtacgtcggggacgtccgcagcgtcacacagaagcatatccaggaggtgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42585 - RNA, 299 nt, synthetic construct
  source 1..299: mol_type = other RNA
cgctcttccgcgtctcatgtacgtcggggacgtccgcagcgtcacacagaagcatatccaggagtgggtgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42586 - RNA, 299 nt, synthetic construct
  source 1..299: mol_type = other RNA
cgctcttccgcgtctcatgtacgtcggggacgtccgcagcgtcacacagaagcatatccaggagtggggcgtgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42587 - RNA, 299 nt, synthetic construct
  source 1..299: mol_type = other RNA
cgctcttccgcgtctcatgtacgtcggggacgtccgcagcgtcacacagaagcatatccaggagtggggcccagtgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42588 - RNA, 299 nt, synthetic construct
  source 1..299: mol_type = other RNA
cgctcttccgcgtctcatgtacgtcggggacgtccgcagcgtcacacagaagcatatccaggagtggggcccattcgtggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42589 - RNA, 299 nt, synthetic construct
  source 1..299: mol_type = other RNA
cgctcttccgcgtctcatgtacgtcggggacgtccgcagcgtcacacagaagcatatccaggagtggggcccattcgacgtgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42590 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42591 - RNA, 299 nt, synthetic construct; identical to SEQ ID NO: 42590
  source 1..299: mol_type = other RNA

SEQ ID NO: 42592 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattgtgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42593 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggagtgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42594 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcgtgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42595 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtgtgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42596 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccgtgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42597 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcgtgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42598 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgtggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42599 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacgtgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42600 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcgtgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42601 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccgtgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42602 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42603 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgtgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42604 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgtgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42605 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgtggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42606 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgtgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42607 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgtgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42608 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggtgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42609 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagtgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42610 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgtgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42611 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgtggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42612 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggtgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42613 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgtgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42614 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgtgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42615 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgtgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42616 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgtgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42617 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgtgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42618 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgtgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42619 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgtggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42620 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggtgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42621 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgtgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42622 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgtgcgcctcctgcatgatgcgcggcccaaggagggagatgatcgccccttcttctggctctttgagaatgtggtggccatgggcgttagtgacaagagggacatcgagacgtcggaagagc

SEQ ID NO: 42623 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgtgctcctgcatgatgcgcggcccaaggagggagatgatcgccccttcttctggctctttgagaatgtggtggccatgggcgttagtgacaagagggacatcgagacgtcggaagagc

SEQ ID NO: 42624 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgtgctgcatgatgcgcggcccaaggagggagatgatcgccccttcttctggctctttgagaatgtggtggccatgggcgttagtgacaagagggacatcgagacgtcggaagagc

SEQ ID NO: 42625 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggtgcatgatgcgcggcccaaggagggagatgatcgccccttcttctggctctttgagaatgtggtggccatgggcgttagtgacaagagggacatcgagacgtcggaagagc

SEQ ID NO: 42626 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgtggatgcgcggcccaaggagggagatgatcgccccttcttctggctctttgagaatgtggtggccatgggcgttagtgacaagagggacatcgagacgtcggaagagc

SEQ ID NO: 42627 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgtggcgcggcccaaggagggagatgatcgccccttcttctggctctttgagaatgtggtggccatgggcgttagtgacaagagggacatcgagacgtcggaagagc

SEQ ID NO: 42628 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggtgcggcccaaggagggagatgatcgccccttcttctggctctttgagaatgtggtggccatgggcgttagtgacaagagggacatcgagacgtcggaagagc

SEQ ID NO: 42629 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggtgcccaaggagggagatgatcgccccttcttctggctctttgagaatgtggtggccatgggcgttagtgacaagagggacatcgagacgtcggaagagc

SEQ ID NO: 42630 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgtgaaggagggagatgatcgccccttcttctggctctttgagaatgtggtggccatgggcgttagtgacaagagggacatcgagacgtcggaagagc

SEQ ID NO: 42631 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggtggagggagatgatcgccccttcttctggctctttgagaatgtggtggccatgggcgttagtgacaagagggacatcgagacgtcggaagagc

SEQ ID NO: 42632 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggtgggagatgatcgccccttcttctggctctttgagaatgtggtggccatgggcgttagtgacaagagggacatcgagacgtcggaagagc

SEQ ID NO: 42633 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagtggatgatcgccccttcttctggctctttgagaatgtggtggccatgggcgttagtgacaagagggacatcgagacgtcggaagagc

SEQ ID NO: 42634 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgtggatcgccccttcttctggctctttgagaatgtggtggccatgggcgttagtgacaagagggacatcgagacgtcggaagagc

SEQ ID NO: 42635 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgtgcgccccttcttctggctctttgagaatgtggtggccatgggcgttagtgacaagagggacatcgagacgtcggaagagc

SEQ ID NO: 42636 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgtgcccttcttctggctctttgagaatgtggtggccatgggcgttagtgacaagagggacatcgagacgtcggaagagc

SEQ ID NO: 42637 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgtgttcttctggctctttgagaatgtggtggccatgggcgttagtgacaagagggacatcgagacgtcggaagagc

SEQ ID NO: 42638 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgtgttctggctctttgagaatgtggtggccatgggcgttagtgacaagagggacatcgagacgtcggaagagc

SEQ ID NO: 42639 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgtgtggctctttgagaatgtggtggccatgggcgttagtgacaagagggacatcgagacgtcggaagagc

SEQ ID NO: 42640 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggtgctctttgagaatgtggtggccatgggcgttagtgacaagagggacatcgagacgtcggaagagc

SEQ ID NO: 42641 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgtgtttgagaatgtggtggccatgggcgttagtgacaagagggacatcgagacgtcggaagagc

SEQ ID NO: 42642 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgtggagaatgtggtggccatgggcgttagtgacaagagggacatcgagacgtcggaagagc

SEQ ID NO: 42643 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggtgaatgtggtggccatgggcgttagtgacaagagggacatcgagacgtcggaagagc

SEQ ID NO: 42644 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggtggccatgggcgttagtgacaagagggacatcgagacgtcggaagagc

SEQ ID NO: 42645 - RNA, 299 nt, synthetic construct; identical to SEQ ID NO: 42644
  source 1..299: mol_type = other RNA

SEQ ID NO: 42646 - RNA, 299 nt, synthetic construct; identical to SEQ ID NO: 42644
  source 1..299: mol_type = other RNA

SEQ ID NO: 42647 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgtgatgggcgttagtgacaagagggacatcgagacgtcggaagagc

SEQ ID NO: 42648 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggtgggcgttagtgacaagagggacatcgagacgtcggaagagc

SEQ ID NO: 42649 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtggttagtgacaagagggacatcgagacgtcggaagagc

SEQ ID NO: 42650 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgtgagtgacaagagggacatcgagacgtcggaagagc

SEQ ID NO: 42651 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgtggacaagagggacatcgagacgtcggaagagc

SEQ ID NO: 42652 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgtgaagagggacatcgagacgtcggaagagc

SEQ ID NO: 42653 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggtgagggacatcgagacgtcggaagagc

SEQ ID NO: 42654 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggtggacatcgagacgtcggaagagc

SEQ ID NO: 42655 - RNA, 299 nt, synthetic construct
  source 1..299: mol_type = other RNA
cgctcttccgcgtctcatgtacgtcgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42656 - RNA, 299 nt, synthetic construct
  source 1..299: mol_type = other RNA
cgctcttccgcgtctcatgtacgtcggggtcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42657 - RNA, 299 nt, synthetic construct
  source 1..299: mol_type = other RNA
cgctcttccgcgtctcatgtacgtcggggacgtcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42658 - RNA, 299 nt, synthetic construct; identical to SEQ ID NO: 42657
  source 1..299: mol_type = other RNA

SEQ ID NO: 42659 - RNA, 299 nt, synthetic construct
  source 1..299: mol_type = other RNA
cgctcttccgcgtctcatgtacgtcggggacgtccgcgtcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42660 - RNA, 299 nt, synthetic construct
  source 1..299: mol_type = other RNA
cgctcttccgcgtctcatgtacgtcggggacgtccgcagcgtcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42661 - RNA, 299 nt, synthetic construct; identical to SEQ ID NO: 42660
  source 1..299: mol_type = other RNA

SEQ ID NO: 42662 - RNA, 299 nt, synthetic construct
  source 1..299: mol_type = other RNA
cgctcttccgcgtctcatgtacgtcggggacgtccgcagcgtcacagtccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42663 - RNA, 299 nt, synthetic construct
  source 1..299: mol_type = other RNA
cgctcttccgcgtctcatgtacgtcggggacgtccgcagcgtcacacaggtcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42664 - RNA, 299 nt, synthetic construct
  source 1..299: mol_type = other RNA
cgctcttccgcgtctcatgtacgtcggggacgtccgcagcgtcacacagaaggtccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42665 - RNA, 299 nt, synthetic construct
  source 1..299: mol_type = other RNA
cgctcttccgcgtctcatgtacgtcggggacgtccgcagcgtcacacagaagcatgtcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42666 - RNA, 299 nt, synthetic construct
  source 1..299: mol_type = other RNA
cgctcttccgcgtctcatgtacgtcggggacgtccgcagcgtcacacagaagcatatcgtccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42667 - RNA, 299 nt, synthetic construct
  source 1..299: mol_type = other RNA
cgctcttccgcgtctcatgtacgtcggggacgtccgcagcgtcacacagaagcatatccaggtcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42668 - RNA, 299 nt, synthetic construct
  source 1..299: mol_type = other RNA
cgctcttccgcgtctcatgtacgtcggggacgtccgcagcgtcacacagaagcatatccaggaggtctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42669 - RNA, 299 nt, synthetic construct
  source 1..299: mol_type = other RNA
cgctcttccgcgtctcatgtacgtcggggacgtccgcagcgtcacacagaagcatatccaggagtgggtcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42670 - RNA, 299 nt, synthetic construct
  source 1..299: mol_type = other RNA
cgctcttccgcgtctcatgtacgtcggggacgtccgcagcgtcacacagaagcatatccaggagtggggcgtcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42671 - RNA, 299 nt, synthetic construct
  source 1..299: mol_type = other RNA
cgctcttccgcgtctcatgtacgtcggggacgtccgcagcgtcacacagaagcatatccaggagtggggcccagtcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42672 - RNA, 299 nt, synthetic construct
  source 1..299: mol_type = other RNA
cgctcttccgcgtctcatgtacgtcggggacgtccgcagcgtcacacagaagcatatccaggagtggggcccattcgtcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42673 - RNA, 299 nt, synthetic construct
  source 1..299: mol_type = other RNA
cgctcttccgcgtctcatgtacgtcggggacgtccgcagcgtcacacagaagcatatccaggagtggggcccattcgacgtcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42674 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42675 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtggtcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42676 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattgtcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42677 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggagtcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42678 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcgtcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42679 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtgtcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42680 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccgtctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42681 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcgtcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42682 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgtcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42683 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacgtcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42684 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcgtctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42685 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccgtcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42686 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42687 - RNA, 299 nt, synthetic construct; identical to SEQ ID NO: 42686
  source 1..299: mol_type = other RNA

SEQ ID NO: 42688 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgtccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42689 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgtcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42690 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgtccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42691 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgtcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42692 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggtcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42693 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagtcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42694 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgtctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42695 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgtcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42696 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggtcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42697 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgtcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42698 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgtcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42699 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgtccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42700 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgtcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42701 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgtcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42702 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgtctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42703 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgtcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42704 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggtcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42705 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgtctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42706 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgtccgcctcctgcatgatgcgcggcccaaggagggagatgatcgccccttcttctggctctttgagaatgtggtggccatgggcgttagtgacaagagggacatcgagacgtcggaagagc

SEQ ID NO: 42707 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgtcctcctgcatgatgcgcggcccaaggagggagatgatcgccccttcttctggctctttgagaatgtggtggccatgggcgttagtgacaagagggacatcgagacgtcggaagagc

SEQ ID NO: 42708 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgtcctgcatgatgcgcggcccaaggagggagatgatcgccccttcttctggctctttgagaatgtggtggccatgggcgttagtgacaagagggacatcgagacgtcggaagagc

SEQ ID NO: 42709 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggtccatgatgcgcggcccaaggagggagatgatcgccccttcttctggctctttgagaatgtggtggccatgggcgttagtgacaagagggacatcgagacgtcggaagagc

SEQ ID NO: 42710 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgtcgatgcgcggcccaaggagggagatgatcgccccttcttctggctctttgagaatgtggtggccatgggcgttagtgacaagagggacatcgagacgtcggaagagc

SEQ ID NO: 42711 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgtcgcgcggcccaaggagggagatgatcgccccttcttctggctctttgagaatgtggtggccatgggcgttagtgacaagagggacatcgagacgtcggaagagc

SEQ ID NO: 42712 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggtccggcccaaggagggagatgatcgccccttcttctggctctttgagaatgtggtggccatgggcgttagtgacaagagggacatcgagacgtcggaagagc

SEQ ID NO: 42713 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggtccccaaggagggagatgatcgccccttcttctggctctttgagaatgtggtggccatgggcgttagtgacaagagggacatcgagacgtcggaagagc

SEQ ID NO: 42714 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgtcaaggagggagatgatcgccccttcttctggctctttgagaatgtggtggccatgggcgttagtgacaagagggacatcgagacgtcggaagagc

SEQ ID NO: 42715 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggtcgagggagatgatcgccccttcttctggctctttgagaatgtggtggccatgggcgttagtgacaagagggacatcgagacgtcggaagagc

SEQ ID NO: 42716 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggtcggagatgatcgccccttcttctggctctttgagaatgtggtggccatgggcgttagtgacaagagggacatcgagacgtcggaagagc

SEQ ID NO: 42717 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagtcgatgatcgccccttcttctggctctttgagaatgtggtggccatgggcgttagtgacaagagggacatcgagacgtcggaagagc

SEQ ID NO: 42718 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgtcgatcgccccttcttctggctctttgagaatgtggtggccatgggcgttagtgacaagagggacatcgagacgtcggaagagc

SEQ ID NO: 42719 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgtccgccccttcttctggctctttgagaatgtggtggccatgggcgttagtgacaagagggacatcgagacgtcggaagagc

SEQ ID NO: 42720 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgtccccttcttctggctctttgagaatgtggtggccatgggcgttagtgacaagagggacatcgagacgtcggaagagc

SEQ ID NO: 42721 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgtcttcttctggctctttgagaatgtggtggccatgggcgttagtgacaagagggacatcgagacgtcggaagagc

SEQ ID NO: 42722 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgtcttctggctctttgagaatgtggtggccatgggcgttagtgacaagagggacatcgagacgtcggaagagc

SEQ ID NO: 42723 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgtctggctctttgagaatgtggtggccatgggcgttagtgacaagagggacatcgagacgtcggaagagc

SEQ ID NO: 42724 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggtcctctttgagaatgtggtggccatgggcgttagtgacaagagggacatcgagacgtcggaagagc

SEQ ID NO: 42725 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgtctttgagaatgtggtggccatgggcgttagtgacaagagggacatcgagacgtcggaagagc

SEQ ID NO: 42726 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgtcgagaatgtggtggccatgggcgttagtgacaagagggacatcgagacgtcggaagagc

SEQ ID NO: 42727 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggtcaatgtggtggccatgggcgttagtgacaagagggacatcgagacgtcggaagagc

SEQ ID NO: 42728 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtcgtggtggccatgggcgttagtgacaagagggacatcgagacgtcggaagagc

SEQ ID NO: 42729 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtcgtggccatgggcgttagtgacaagagggacatcgagacgtcggaagagc

SEQ ID NO: 42730 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggtcgccatgggcgttagtgacaagagggacatcgagacgtcggaagagc

SEQ ID NO: 42731 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgtcatgggcgttagtgacaagagggacatcgagacgtcggaagagc

SEQ ID NO: 42732 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggtcggcgttagtgacaagagggacatcgagacgtcggaagagc

SEQ ID NO: 42733 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgtcgttagtgacaagagggacatcgagacgtcggaagagc

SEQ ID NO: 42734 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgtcagtgacaagagggacatcgagacgtcggaagagc

SEQ ID NO: 42735 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgtcgacaagagggacatcgagacgtcggaagagc

SEQ ID NO: 42736 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgtcaagagggacatcgagacgtcggaagagc

SEQ ID NO: 42737 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggtcagggacatcgagacgtcggaagagc

SEQ ID NO: 42738 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggtcgacatcgagacgtcggaagagc

SEQ ID NO: 42739 - RNA, 299 nt, synthetic construct
  source 1..299: mol_type = other RNA
cgctcttccgcgtctcatgtacgtcgggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42740 - RNA, 299 nt, synthetic construct; identical to SEQ ID NO: 42739
  source 1..299: mol_type = other RNA

SEQ ID NO: 42741 - RNA, 299 nt, synthetic construct
  source 1..299: mol_type = other RNA
cgctcttccgcgtctcatgtacgtcggggacggggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42742 - RNA, 299 nt, synthetic construct
  source 1..299: mol_type = other RNA
cgctcttccgcgtctcatgtacgtcggggacgtcgggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42743 - RNA, 299 nt, synthetic construct
  source 1..299: mol_type = other RNA
cgctcttccgcgtctcatgtacgtcggggacgtccgcgggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42744 - RNA, 299 nt, synthetic construct
  source 1..299: mol_type = other RNA
cgctcttccgcgtctcatgtacgtcggggacgtccgcagcggggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42745 - RNA, 299 nt, synthetic construct
  source 1..299: mol_type = other RNA
cgctcttccgcgtctcatgtacgtcggggacgtccgcagcgtcgggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42746 - RNA, 299 nt, synthetic construct
  source 1..299: mol_type = other RNA
cgctcttccgcgtctcatgtacgtcggggacgtccgcagcgtcacagggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42747 - RNA, 299 nt, synthetic construct
  source 1..299: mol_type = other RNA
cgctcttccgcgtctcatgtacgtcggggacgtccgcagcgtcacacaggggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42748 - RNA, 299 nt, synthetic construct
  source 1..299: mol_type = other RNA
cgctcttccgcgtctcatgtacgtcggggacgtccgcagcgtcacacagaaggggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42749 - RNA, 299 nt, synthetic construct
  source 1..299: mol_type = other RNA
cgctcttccgcgtctcatgtacgtcggggacgtccgcagcgtcacacagaagcatgggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42750 - RNA, 299 nt, synthetic construct
  source 1..299: mol_type = other RNA
cgctcttccgcgtctcatgtacgtcggggacgtccgcagcgtcacacagaagcatatcgggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42751 - RNA, 299 nt, synthetic construct
  source 1..299: mol_type = other RNA
cgctcttccgcgtctcatgtacgtcggggacgtccgcagcgtcacacagaagcatatccagggggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42752 - RNA, 299 nt, synthetic construct
  source 1..299: mol_type = other RNA
cgctcttccgcgtctcatgtacgtcggggacgtccgcagcgtcacacagaagcatatccaggaggggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42753 - RNA, 299 nt, synthetic construct
  source 1..299: mol_type = other RNA
cgctcttccgcgtctcatgtacgtcggggacgtccgcagcgtcacacagaagcatatccaggagtgggggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42754 - RNA, 299 nt, synthetic construct
  source 1..299: mol_type = other RNA
cgctcttccgcgtctcatgtacgtcggggacgtccgcagcgtcacacagaagcatatccaggagtggggcgggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42755 - RNA, 299 nt, synthetic construct
  source 1..299: mol_type = other RNA
cgctcttccgcgtctcatgtacgtcggggacgtccgcagcgtcacacagaagcatatccaggagtggggcccagggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42756 - RNA, 299 nt, synthetic construct
  source 1..299: mol_type = other RNA
cgctcttccgcgtctcatgtacgtcggggacgtccgcagcgtcacacagaagcatatccaggagtggggcccattcggggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42757 - RNA, 299 nt, synthetic construct
  source 1..299: mol_type = other RNA
cgctcttccgcgtctcatgtacgtcggggacgtccgcagcgtcacacagaagcatatccaggagtggggcccattcgacgggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42758 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgggggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42759 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtggggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42760 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattgggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42761 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggagggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42762 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcgggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42763 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtgggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42764 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccgggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42765 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcgggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42766 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacggggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42767 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacgggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42768 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcgggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42769 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccgggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42770 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattggggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42771 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42772 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42773 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctggggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42774 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42775 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42776 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42777 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42778 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42779 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatggggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42780 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42781 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42782 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42783 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42784 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42785 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42786 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42787 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttggggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42788 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42789 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42790 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgggcgcctcctgcatgatgcgcggcccaaggagggagatgatcgccccttcttctggctctttgagaatgtggtggccatgggcgttagtgacaagagggacatcgagacgtcggaagagc

SEQ ID NO: 42791 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgggctcctgcatgatgcgcggcccaaggagggagatgatcgccccttcttctggctctttgagaatgtggtggccatgggcgttagtgacaagagggacatcgagacgtcggaagagc

SEQ ID NO: 42792 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgggctgcatgatgcgcggcccaaggagggagatgatcgccccttcttctggctctttgagaatgtggtggccatgggcgttagtgacaagagggacatcgagacgtcggaagagc

SEQ ID NO: 42793 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggggcatgatgcgcggcccaaggagggagatgatcgccccttcttctggctctttgagaatgtggtggccatgggcgttagtgacaagagggacatcgagacgtcggaagagc

SEQ ID NO: 42794 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatggggatgcgcggcccaaggagggagatgatcgccccttcttctggctctttgagaatgtggtggccatgggcgttagtgacaagagggacatcgagacgtcggaagagc

SEQ ID NO: 42795 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatggggcgcggcccaaggagggagatgatcgccccttcttctggctctttgagaatgtggtggccatgggcgttagtgacaagagggacatcgagacgtcggaagagc

SEQ ID NO: 42796 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggggcggcccaaggagggagatgatcgccccttcttctggctctttgagaatgtggtggccatgggcgttagtgacaagagggacatcgagacgtcggaagagc

SEQ ID NO: 42797 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggggcccaaggagggagatgatcgccccttcttctggctctttgagaatgtggtggccatgggcgttagtgacaagagggacatcgagacgtcggaagagc

SEQ ID NO: 42798 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgggaaggagggagatgatcgccccttcttctggctctttgagaatgtggtggccatgggcgttagtgacaagagggacatcgagacgtcggaagagc

SEQ ID NO: 42799 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagggggagggagatgatcgccccttcttctggctctttgagaatgtggtggccatgggcgttagtgacaagagggacatcgagacgtcggaagagc

SEQ ID NO: 42800 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggggggagatgatcgccccttcttctggctctttgagaatgtggtggccatgggcgttagtgacaagagggacatcgagacgtcggaagagc

SEQ ID NO: 42801 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaggggatgatcgccccttcttctggctctttgagaatgtggtggccatgggcgttagtgacaagagggacatcgagacgtcggaagagc

SEQ ID NO: 42802 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatggggatcgccccttcttctggctctttgagaatgtggtggccatgggcgttagtgacaagagggacatcgagacgtcggaagagc

SEQ ID NO: 42803 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgggcgccccttcttctggctctttgagaatgtggtggccatgggcgttagtgacaagagggacatcgagacgtcggaagagc

SEQ ID NO: 42804 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgggcccttcttctggctctttgagaatgtggtggccatgggcgttagtgacaagagggacatcgagacgtcggaagagc

SEQ ID NO: 42805 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgggttcttctggctctttgagaatgtggtggccatgggcgttagtgacaagagggacatcgagacgtcggaagagc

SEQ ID NO: 42806 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgggttctggctctttgagaatgtggtggccatgggcgttagtgacaagagggacatcgagacgtcggaagagc

SEQ ID NO: 42807 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgggtggctctttgagaatgtggtggccatgggcgttagtgacaagagggacatcgagacgtcggaagagc

SEQ ID NO: 42808 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggggctctttgagaatgtggtggccatgggcgttagtgacaagagggacatcgagacgtcggaagagc

SEQ ID NO: 42809 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgggtttgagaatgtggtggccatgggcgttagtgacaagagggacatcgagacgtcggaagagc

SEQ ID NO: 42810 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttggggagaatgtggtggccatgggcgttagtgacaagagggacatcgagacgtcggaagagc

SEQ ID NO: 42811 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggggaatgtggtggccatgggcgttagtgacaagagggacatcgagacgtcggaagagc

SEQ ID NO: 42812 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatggggtggtggccatgggcgttagtgacaagagggacatcgagacgtcggaagagc

SEQ ID NO: 42813 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgggggtggccatgggcgttagtgacaagagggacatcgagacgtcggaagagc

SEQ ID NO: 42814 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgggggccatgggcgttagtgacaagagggacatcgagacgtcggaagagc

SEQ ID NO: 42815 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgggatgggcgttagtgacaagagggacatcgagacgtcggaagagc

SEQ ID NO: 42816 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggggggcgttagtgacaagagggacatcgagacgtcggaagagc

SEQ ID NO: 42817 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcggggttagtgacaagagggacatcgagacgtcggaagagc

SEQ ID NO: 42818 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgggagtgacaagagggacatcgagacgtcggaagagc

SEQ ID NO: 42819 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtggggacaagagggacatcgagacgtcggaagagc

SEQ ID NO: 42820 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgggaagagggacatcgagacgtcggaagagc

SEQ ID NO: 42821 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggggagggacatcgagacgtcggaagagc

SEQ ID NO: 42822 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggggggacatcgagacgtcggaagagc

SEQ ID NO: 42823 - RNA, 299 nt, synthetic construct
  source 1..299: mol_type = other RNA
cgctcttccgcgtctcatgtacgtcggcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42824 - RNA, 299 nt, synthetic construct
  source 1..299: mol_type = other RNA
cgctcttccgcgtctcatgtacgtcgggggcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42825 - RNA, 299 nt, synthetic construct
  source 1..299: mol_type = other RNA
cgctcttccgcgtctcatgtacgtcggggacggcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42826 - RNA, 299 nt, synthetic construct
  source 1..299: mol_type = other RNA
cgctcttccgcgtctcatgtacgtcggggacgtcggccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42827 - RNA, 299 nt, synthetic construct
  source 1..299: mol_type = other RNA
cgctcttccgcgtctcatgtacgtcggggacgtccgcggcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42828 - RNA, 299 nt, synthetic construct
  source 1..299: mol_type = other RNA
cgctcttccgcgtctcatgtacgtcggggacgtccgcagcggcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42829 - RNA, 299 nt, synthetic construct
  source 1..299: mol_type = other RNA
cgctcttccgcgtctcatgtacgtcggggacgtccgcagcgtcggcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42830 - RNA, 299 nt, synthetic construct
  source 1..299: mol_type = other RNA
cgctcttccgcgtctcatgtacgtcggggacgtccgcagcgtcacaggccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42831 - RNA, 299 nt, synthetic construct
  source 1..299: mol_type = other RNA
cgctcttccgcgtctcatgtacgtcggggacgtccgcagcgtcacacagggcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42832 - RNA, 299 nt, synthetic construct
  source 1..299: mol_type = other RNA
cgctcttccgcgtctcatgtacgtcggggacgtccgcagcgtcacacagaagggccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42833 - RNA, 299 nt, synthetic construct
  source 1..299: mol_type = other RNA
cgctcttccgcgtctcatgtacgtcggggacgtccgcagcgtcacacagaagcatggcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42834 - RNA, 299 nt, synthetic construct
  source 1..299: mol_type = other RNA
cgctcttccgcgtctcatgtacgtcggggacgtccgcagcgtcacacagaagcatatcggccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42835 - RNA, 299 nt, synthetic construct
  source 1..299: mol_type = other RNA
cgctcttccgcgtctcatgtacgtcggggacgtccgcagcgtcacacagaagcatatccagggcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42836 - RNA, 299 nt, synthetic construct
  source 1..299: mol_type = other RNA
cgctcttccgcgtctcatgtacgtcggggacgtccgcagcgtcacacagaagcatatccaggagggctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42837 - RNA, 299 nt, synthetic construct
  source 1..299: mol_type = other RNA
cgctcttccgcgtctcatgtacgtcggggacgtccgcagcgtcacacagaagcatatccaggagtggggcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42838 - RNA, 299 nt, synthetic construct; identical to SEQ ID NO: 42837
  source 1..299: mol_type = other RNA

SEQ ID NO: 42839 - RNA, 299 nt, synthetic construct
  source 1..299: mol_type = other RNA
cgctcttccgcgtctcatgtacgtcggggacgtccgcagcgtcacacagaagcatatccaggagtggggcccaggcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42840 - RNA, 299 nt, synthetic construct
  source 1..299: mol_type = other RNA
cgctcttccgcgtctcatgtacgtcggggacgtccgcagcgtcacacagaagcatatccaggagtggggcccattcggcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42841 - RNA, 299 nt, synthetic construct
  source 1..299: mol_type = other RNA
cgctcttccgcgtctcatgtacgtcggggacgtccgcagcgtcacacagaagcatatccaggagtggggcccattcgacggcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42842 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgggcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42843 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgggcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42844 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42845 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42846 - RNA, 299 nt, synthetic construct; identical to SEQ ID NO: 42845
  source 1..299: mol_type = other RNA

SEQ ID NO: 42847 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtggcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42848 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccggctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42849 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcggcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42850 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacggcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42851 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacggcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42852 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcggctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42853 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccggcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42854 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattggcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42855 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcggcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42856 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacggccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42857 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctggcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42858 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccggccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42859 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcggcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42860 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42861 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaggcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42862 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttggctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42863 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatggcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42864 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42865 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtggcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42866 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42867 - RNA, 299 nt, synthetic construct; identical to SEQ ID NO: 42866
  source 1..299: mol_type = other RNA

SEQ ID NO: 42868 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcggcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42869 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcggcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42870 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcggctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42871 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttggcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42872 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagggcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42873 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcggctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42874 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacggccgcctcctgcatgatgcgcggcccaaggagggagatgatcgccccttcttctggctctttgagaatgtggtggccatgggcgttagtgacaagagggacatcgagacgtcggaagagc

SEQ ID NO: 42875 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcggcctcctgcatgatgcgcggcccaaggagggagatgatcgccccttcttctggctctttgagaatgtggtggccatgggcgttagtgacaagagggacatcgagacgtcggaagagc

SEQ ID NO: 42876 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcggcctgcatgatgcgcggcccaaggagggagatgatcgccccttcttctggctctttgagaatgtggtggccatgggcgttagtgacaagagggacatcgagacgtcggaagagc

SEQ ID NO: 42877 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgggccatgatgcgcggcccaaggagggagatgatcgccccttcttctggctctttgagaatgtggtggccatgggcgttagtgacaagagggacatcgagacgtcggaagagc

SEQ ID NO: 42878 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatggcgatgcgcggcccaaggagggagatgatcgccccttcttctggctctttgagaatgtggtggccatgggcgttagtgacaagagggacatcgagacgtcggaagagc

SEQ ID NO: 42879 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatggcgcgcggcccaaggagggagatgatcgccccttcttctggctctttgagaatgtggtggccatgggcgttagtgacaagagggacatcgagacgtcggaagagc

SEQ ID NO: 42880 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgggccggcccaaggagggagatgatcgccccttcttctggctctttgagaatgtggtggccatgggcgttagtgacaagagggacatcgagacgtcggaagagc

SEQ ID NO: 42881 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggggccccaaggagggagatgatcgccccttcttctggctctttgagaatgtggtggccatgggcgttagtgacaagagggacatcgagacgtcggaagagc

SEQ ID NO: 42882 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccggcaaggagggagatgatcgccccttcttctggctctttgagaatgtggtggccatgggcgttagtgacaagagggacatcgagacgtcggaagagc

SEQ ID NO: 42883 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagggcgagggagatgatcgccccttcttctggctctttgagaatgtggtggccatgggcgttagtgacaagagggacatcgagacgtcggaagagc

SEQ ID NO: 42884 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggcggagatgatcgccccttcttctggctctttgagaatgtggtggccatgggcgttagtgacaagagggacatcgagacgtcggaagagc

SEQ ID NO: 42885 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaggcgatgatcgccccttcttctggctctttgagaatgtggtggccatgggcgttagtgacaagagggacatcgagacgtcggaagagc

SEQ ID NO: 42886 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatggcgatcgccccttcttctggctctttgagaatgtggtggccatgggcgttagtgacaagagggacatcgagacgtcggaagagc

SEQ ID NO: 42887 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatggccgccccttcttctggctctttgagaatgtggtggccatgggcgttagtgacaagagggacatcgagacgtcggaagagc

SEQ ID NO: 42888 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcggccccttcttctggctctttgagaatgtggtggccatgggcgttagtgacaagagggacatcgagacgtcggaagagc

SEQ ID NO: 42889 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccggcttcttctggctctttgagaatgtggtggccatgggcgttagtgacaagagggacatcgagacgtcggaagagc

SEQ ID NO: 42890 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcggcttctggctctttgagaatgtggtggccatgggcgttagtgacaagagggacatcgagacgtcggaagagc

SEQ ID NO: 42891 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcggctggctctttgagaatgtggtggccatgggcgttagtgacaagagggacatcgagacgtcggaagagc

SEQ ID NO: 42892 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggggcctctttgagaatgtggtggccatgggcgttagtgacaagagggacatcgagacgtcggaagagc

SEQ ID NO: 42893 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcggctttgagaatgtggtggccatgggcgttagtgacaagagggacatcgagacgtcggaagagc

SEQ ID NO: 42894 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttggcgagaatgtggtggccatgggcgttagtgacaagagggacatcgagacgtcggaagagc

SEQ ID NO: 42895 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagggcaatgtggtggccatgggcgttagtgacaagagggacatcgagacgtcggaagagc

SEQ ID NO: 42896 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatggcgtggtggccatgggcgttagtgacaagagggacatcgagacgtcggaagagc

SEQ ID NO: 42897 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgggcgtggccatgggcgttagtgacaagagggacatcgagacgtcggaagagc

SEQ ID NO: 42898 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgggcgccatgggcgttagtgacaagagggacatcgagacgtcggaagagc

SEQ ID NO: 42899 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccggcatgggcgttagtgacaagagggacatcgagacgtcggaagagc

SEQ ID NO: 42900 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcggcgttagtgacaagagggacatcgagacgtcggaagagc

SEQ ID NO: 42901 - RNA, 299 nt, synthetic construct; identical to SEQ ID NO: 42900
  source 1..299: mol_type = other RNA

SEQ ID NO: 42902 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttggcagtgacaagagggacatcgagacgtcggaagagc

SEQ ID NO: 42903 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtggcgacaagagggacatcgagacgtcggaagagc

SEQ ID NO: 42904 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacggcaagagggacatcgagacgtcggaagagc

SEQ ID NO: 42905 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagggcagggacatcgagacgtcggaagagc

SEQ ID NO: 42906 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggggcgacatcgagacgtcggaagagc

SEQ ID NO: 42907 - RNA, 299 nt, synthetic construct
  source 1..299: mol_type = other RNA
cgctcttccgcgtctcatgtacgtcgcgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42908 - RNA, 299 nt, synthetic construct
  source 1..299: mol_type = other RNA
cgctcttccgcgtctcatgtacgtcggggcggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42909 - RNA, 299 nt, synthetic construct
  source 1..299: mol_type = other RNA
cgctcttccgcgtctcatgtacgtcggggacgcggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42910 - RNA, 299 nt, synthetic construct
  source 1..299: mol_type = other RNA
cgctcttccgcgtctcatgtacgtcggggacgtcgcgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42911 - RNA, 299 nt, synthetic construct
  source 1..299: mol_type = other RNA
cgctcttccgcgtctcatgtacgtcggggacgtccgcgcgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42912 - RNA, 299 nt, synthetic construct
  source 1..299: mol_type = other RNA
cgctcttccgcgtctcatgtacgtcggggacgtccgcagcgcggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42913 - RNA, 299 nt, synthetic construct
  source 1..299: mol_type = other RNA
cgctcttccgcgtctcatgtacgtcggggacgtccgcagcgtcgcgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42914 - RNA, 299 nt, synthetic construct
  source 1..299: mol_type = other RNA
cgctcttccgcgtctcatgtacgtcggggacgtccgcagcgtcacagcgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42915 - RNA, 299 nt, synthetic construct
  source 1..299: mol_type = other RNA
cgctcttccgcgtctcatgtacgtcggggacgtccgcagcgtcacacaggcgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42916 - RNA, 299 nt, synthetic construct
  source 1..299: mol_type = other RNA
cgctcttccgcgtctcatgtacgtcggggacgtccgcagcgtcacacagaaggcgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42917 - RNA, 299 nt, synthetic construct
  source 1..299: mol_type = other RNA
cgctcttccgcgtctcatgtacgtcggggacgtccgcagcgtcacacagaagcatgcgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42918 - RNA, 299 nt, synthetic construct
  source 1..299: mol_type = other RNA
cgctcttccgcgtctcatgtacgtcggggacgtccgcagcgtcacacagaagcatatcgcgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42919 - RNA, 299 nt, synthetic construct
  source 1..299: mol_type = other RNA
cgctcttccgcgtctcatgtacgtcggggacgtccgcagcgtcacacagaagcatatccaggcggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42920 - RNA, 299 nt, synthetic construct
  source 1..299: mol_type = other RNA
cgctcttccgcgtctcatgtacgtcggggacgtccgcagcgtcacacagaagcatatccaggaggcgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42921 - RNA, 299 nt, synthetic construct
  source 1..299: mol_type = other RNA
cgctcttccgcgtctcatgtacgtcggggacgtccgcagcgtcacacagaagcatatccaggagtgggcgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42922 - RNA, 299 nt, synthetic construct
  source 1..299: mol_type = other RNA
cgctcttccgcgtctcatgtacgtcggggacgtccgcagcgtcacacagaagcatatccaggagtggggcgcgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42923 - RNA, 299 nt, synthetic construct
  source 1..299: mol_type = other RNA
cgctcttccgcgtctcatgtacgtcggggacgtccgcagcgtcacacagaagcatatccaggagtggggcccagcgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42924 - RNA, 299 nt, synthetic construct
  source 1..299: mol_type = other RNA
cgctcttccgcgtctcatgtacgtcggggacgtccgcagcgtcacacagaagcatatccaggagtggggcccattcgcggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42925 - RNA, 299 nt, synthetic construct
  source 1..299: mol_type = other RNA
cgctcttccgcgtctcatgtacgtcggggacgtccgcagcgtcacacagaagcatatccaggagtggggcccattcgacgcgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42926 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggcggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42927 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtggcgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42928 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattgcgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42929 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggagcgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42930 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcgcgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42931 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtgcgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42932 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccgcgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42933 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcgcgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42934 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgcggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42935 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacgcgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42936 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcgcgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42937 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccgcgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42938 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgcggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42939 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgcgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42940 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgcgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42941 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42942 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgcgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42943 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgcgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42944 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggcgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42945 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagcgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42946 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgcgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42947 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgcggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42948 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggcgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42949 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgcgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42950 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgcgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42951 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgcgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42952 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgcgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42953 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgcgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42954 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgcgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42955 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgcggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42956 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggcgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42957 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgcgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42958 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgcgcgcctcctgcatgatgcgcggcccaaggagggagatgatcgccccttcttctggctctttgagaatgtggtggccatgggcgttagtgacaagagggacatcgagacgtcggaagagc

SEQ ID NO: 42959 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgcgctcctgcatgatgcgcggcccaaggagggagatgatcgccccttcttctggctctttgagaatgtggtggccatgggcgttagtgacaagagggacatcgagacgtcggaagagc

SEQ ID NO: 42960 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgcgctgcatgatgcgcggcccaaggagggagatgatcgccccttcttctggctctttgagaatgtggtggccatgggcgttagtgacaagagggacatcgagacgtcggaagagc

SEQ ID NO: 42961 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggcgcatgatgcgcggcccaaggagggagatgatcgccccttcttctggctctttgagaatgtggtggccatgggcgttagtgacaagagggacatcgagacgtcggaagagc

SEQ ID NO: 42962 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgcggatgcgcggcccaaggagggagatgatcgccccttcttctggctctttgagaatgtggtggccatgggcgttagtgacaagagggacatcgagacgtcggaagagc

SEQ ID NO: 42963 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggcgcggcccaaggagggagatgatcgccccttcttctggctctttgagaatgtggtggccatgggcgttagtgacaagagggacatcgagacgtcggaagagc

SEQ ID NO: 42964 - RNA, 299 nt, synthetic construct; identical to SEQ ID NO: 42963
  source 1..299: mol_type = other RNA

SEQ ID NO: 42965 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggcgcccaaggagggagatgatcgccccttcttctggctctttgagaatgtggtggccatgggcgttagtgacaagagggacatcgagacgtcggaagagc

SEQ ID NO: 42966 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgcgaaggagggagatgatcgccccttcttctggctctttgagaatgtggtggccatgggcgttagtgacaagagggacatcgagacgtcggaagagc

SEQ ID NO: 42967 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggcggagggagatgatcgccccttcttctggctctttgagaatgtggtggccatgggcgttagtgacaagagggacatcgagacgtcggaagagc

SEQ ID NO: 42968 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggcgggagatgatcgccccttcttctggctctttgagaatgtggtggccatgggcgttagtgacaagagggacatcgagacgtcggaagagc

SEQ ID NO: 42969 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagcggatgatcgccccttcttctggctctttgagaatgtggtggccatgggcgttagtgacaagagggacatcgagacgtcggaagagc

SEQ ID NO: 42970 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgcggatcgccccttcttctggctctttgagaatgtggtggccatgggcgttagtgacaagagggacatcgagacgtcggaagagc

SEQ ID NO: 42971 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgcgcgccccttcttctggctctttgagaatgtggtggccatgggcgttagtgacaagagggacatcgagacgtcggaagagc

SEQ ID NO: 42972 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgcgcccttcttctggctctttgagaatgtggtggccatgggcgttagtgacaagagggacatcgagacgtcggaagagc

SEQ ID NO: 42973 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgcgttcttctggctctttgagaatgtggtggccatgggcgttagtgacaagagggacatcgagacgtcggaagagc

SEQ ID NO: 42974 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgcgttctggctctttgagaatgtggtggccatgggcgttagtgacaagagggacatcgagacgtcggaagagc

SEQ ID NO: 42975 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgcgtggctctttgagaatgtggtggccatgggcgttagtgacaagagggacatcgagacgtcggaagagc

SEQ ID NO: 42976 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggcgctctttgagaatgtggtggccatgggcgttagtgacaagagggacatcgagacgtcggaagagc

SEQ ID NO: 42977 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgcgtttgagaatgtggtggccatgggcgttagtgacaagagggacatcgagacgtcggaagagc

SEQ ID NO: 42978 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgcggagaatgtggtggccatgggcgttagtgacaagagggacatcgagacgtcggaagagc

SEQ ID NO: 42979 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggcgaatgtggtggccatgggcgttagtgacaagagggacatcgagacgtcggaagagc

SEQ ID NO: 42980 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgcggtggtggccatgggcgttagtgacaagagggacatcgagacgtcggaagagc

SEQ ID NO: 42981 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggcggtggccatgggcgttagtgacaagagggacatcgagacgtcggaagagc

SEQ ID NO: 42982 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcggccatgggcgttagtgacaagagggacatcgagacgtcggaagagc

SEQ ID NO: 42983 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgcgatgggcgttagtgacaagagggacatcgagacgtcggaagagc

SEQ ID NO: 42984 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggcgggcgttagtgacaagagggacatcgagacgtcggaagagc

SEQ ID NO: 42985 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgcggttagtgacaagagggacatcgagacgtcggaagagc

SEQ ID NO: 42986 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgcgagtgacaagagggacatcgagacgtcggaagagc

SEQ ID NO: 42987 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgcggacaagagggacatcgagacgtcggaagagc

SEQ ID NO: 42988 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgcgaagagggacatcgagacgtcggaagagc

SEQ ID NO: 42989 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggcgagggacatcgagacgtcggaagagc

SEQ ID NO: 42990 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggcggacatcgagacgtcggaagagc

SEQ ID NO: 42991 - RNA, 299 nt, synthetic construct
  source 1..299: mol_type = other RNA
cgctcttccgcgtctcatgtacgtcgccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42992 - RNA, 299 nt, synthetic construct
  source 1..299: mol_type = other RNA
cgctcttccgcgtctcatgtacgtcggggccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42993 - RNA, 299 nt, synthetic construct
  source 1..299: mol_type = other RNA
cgctcttccgcgtctcatgtacgtcggggacgccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42994 - RNA, 299 nt, synthetic construct
  source 1..299: mol_type = other RNA
cgctcttccgcgtctcatgtacgtcggggacgtcgcccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42995 - RNA, 299 nt, synthetic construct
  source 1..299: mol_type = other RNA
cgctcttccgcgtctcatgtacgtcggggacgtccgcgccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42996 - RNA, 299 nt, synthetic construct
  source 1..299: mol_type = other RNA
cgctcttccgcgtctcatgtacgtcggggacgtccgcagcgccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42997 - RNA, 299 nt, synthetic construct
  source 1..299: mol_type = other RNA
cgctcttccgcgtctcatgtacgtcggggacgtccgcagcgtcgccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42998 - RNA, 299 nt, synthetic construct
  source 1..299: mol_type = other RNA
cgctcttccgcgtctcatgtacgtcggggacgtccgcagcgtcacagcccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 42999 - RNA, 299 nt, synthetic construct
  source 1..299: mol_type = other RNA
cgctcttccgcgtctcatgtacgtcggggacgtccgcagcgtcacacaggccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43000 - RNA, 299 nt, synthetic construct
  source 1..299: mol_type = other RNA
cgctcttccgcgtctcatgtacgtcggggacgtccgcagcgtcacacagaaggcccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43001 - RNA, 299 nt, synthetic construct
  source 1..299: mol_type = other RNA
cgctcttccgcgtctcatgtacgtcggggacgtccgcagcgtcacacagaagcatgccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43002 - RNA, 299 nt, synthetic construct
  source 1..299: mol_type = other RNA
cgctcttccgcgtctcatgtacgtcggggacgtccgcagcgtcacacagaagcatatcgcccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43003 - RNA, 299 nt, synthetic construct
  source 1..299: mol_type = other RNA
cgctcttccgcgtctcatgtacgtcggggacgtccgcagcgtcacacagaagcatatccaggccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43004 - RNA, 299 nt, synthetic construct
  source 1..299: mol_type = other RNA
cgctcttccgcgtctcatgtacgtcggggacgtccgcagcgtcacacagaagcatatccaggaggcctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43005 - RNA, 299 nt, synthetic construct
  source 1..299: mol_type = other RNA
cgctcttccgcgtctcatgtacgtcggggacgtccgcagcgtcacacagaagcatatccaggagtgggccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43006 - RNA, 299 nt, synthetic construct
  source 1..299: mol_type = other RNA
cgctcttccgcgtctcatgtacgtcggggacgtccgcagcgtcacacagaagcatatccaggagtggggcgccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43007 - RNA, 299 nt, synthetic construct
  source 1..299: mol_type = other RNA
cgctcttccgcgtctcatgtacgtcggggacgtccgcagcgtcacacagaagcatatccaggagtggggcccagccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43008 - RNA, 299 nt, synthetic construct
  source 1..299: mol_type = other RNA
cgctcttccgcgtctcatgtacgtcggggacgtccgcagcgtcacacagaagcatatccaggagtggggcccattcgccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43009 - RNA, 299 nt, synthetic construct
  source 1..299: mol_type = other RNA
cgctcttccgcgtctcatgtacgtcggggacgtccgcagcgtcacacagaagcatatccaggagtggggcccattcgacgccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43010 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43011 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtggccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43012 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattgccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43013 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggagccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43014 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcgccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43015 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtgccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43016 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccgcctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43017 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcgccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43018 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43019 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacgccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43020 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcgcctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43021 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccgccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43022 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43023 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcgccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43024 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgcccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43025 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43026 - RNA, 299 nt, synthetic construct; identical to SEQ ID NO: 43025
  source 1..299: mol_type = other RNA

SEQ ID NO: 43027 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcgccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43028 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaaggccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43029 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggagccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43030 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgcctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43031 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43032 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgaggccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43033 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtgccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43034 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactgccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43035 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcgcccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43036 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcgccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43037 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcgccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43038 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgcctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43039 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43040 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgaggccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43041 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcgcctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43042 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacgcccgcctcctgcatgatgcgcggcccaaggagggagatgatcgccccttcttctggctctttgagaatgtggtggccatgggcgttagtgacaagagggacatcgagacgtcggaagagc

SEQ ID NO: 43043 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcgccctcctgcatgatgcgcggcccaaggagggagatgatcgccccttcttctggctctttgagaatgtggtggccatgggcgttagtgacaagagggacatcgagacgtcggaagagc

SEQ ID NO: 43044 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcgccctgcatgatgcgcggcccaaggagggagatgatcgccccttcttctggctctttgagaatgtggtggccatgggcgttagtgacaagagggacatcgagacgtcggaagagc

SEQ ID NO: 43045 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggcccatgatgcgcggcccaaggagggagatgatcgccccttcttctggctctttgagaatgtggtggccatgggcgttagtgacaagagggacatcgagacgtcggaagagc

SEQ ID NO: 43046 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgccgatgcgcggcccaaggagggagatgatcgccccttcttctggctctttgagaatgtggtggccatgggcgttagtgacaagagggacatcgagacgtcggaagagc

SEQ ID NO: 43047 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgccgcgcggcccaaggagggagatgatcgccccttcttctggctctttgagaatgtggtggccatgggcgttagtgacaagagggacatcgagacgtcggaagagc

SEQ ID NO: 43048 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcggcccggcccaaggagggagatgatcgccccttcttctggctctttgagaatgtggtggccatgggcgttagtgacaagagggacatcgagacgtcggaagagc

SEQ ID NO: 43049 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgggcccccaaggagggagatgatcgccccttcttctggctctttgagaatgtggtggccatgggcgttagtgacaagagggacatcgagacgtcggaagagc

SEQ ID NO: 43050 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgccaaggagggagatgatcgccccttcttctggctctttgagaatgtggtggccatgggcgttagtgacaagagggacatcgagacgtcggaagagc

SEQ ID NO: 43051 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggccgagggagatgatcgccccttcttctggctctttgagaatgtggtggccatgggcgttagtgacaagagggacatcgagacgtcggaagagc

SEQ ID NO: 43052 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggccggagatgatcgccccttcttctggctctttgagaatgtggtggccatgggcgttagtgacaagagggacatcgagacgtcggaagagc

SEQ ID NO: 43053 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagccgatgatcgccccttcttctggctctttgagaatgtggtggccatgggcgttagtgacaagagggacatcgagacgtcggaagagc

SEQ ID NO: 43054 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgccgatcgccccttcttctggctctttgagaatgtggtggccatgggcgttagtgacaagagggacatcgagacgtcggaagagc

SEQ ID NO: 43055 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatgcccgccccttcttctggctctttgagaatgtggtggccatgggcgttagtgacaagagggacatcgagacgtcggaagagc

SEQ ID NO: 43056 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcgcccccttcttctggctctttgagaatgtggtggccatgggcgttagtgacaagagggacatcgagacgtcggaagagc

SEQ ID NO: 43057 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccgccttcttctggctctttgagaatgtggtggccatgggcgttagtgacaagagggacatcgagacgtcggaagagc

SEQ ID NO: 43058 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcgccttctggctctttgagaatgtggtggccatgggcgttagtgacaagagggacatcgagacgtcggaagagc

SEQ ID NO: 43059 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcgcctggctctttgagaatgtggtggccatgggcgttagtgacaagagggacatcgagacgtcggaagagc

SEQ ID NO: 43060 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctgggccctctttgagaatgtggtggccatgggcgttagtgacaagagggacatcgagacgtcggaagagc

SEQ ID NO: 43061 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgcctttgagaatgtggtggccatgggcgttagtgacaagagggacatcgagacgtcggaagagc

SEQ ID NO: 43062 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgccgagaatgtggtggccatgggcgttagtgacaagagggacatcgagacgtcggaagagc

SEQ ID NO: 43063 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggccaatgtggtggccatgggcgttagtgacaagagggacatcgagacgtcggaagagc

SEQ ID NO: 43064 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgccgtggtggccatgggcgttagtgacaagagggacatcgagacgtcggaagagc

SEQ ID NO: 43065 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggccgtggccatgggcgttagtgacaagagggacatcgagacgtcggaagagc

SEQ ID NO: 43066 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccgccatgggcgttagtgacaagagggacatcgagacgtcggaagagc

SEQ ID NO: 43067 - RNA, 299 nt, synthetic construct; identical to SEQ ID NO: 43066
  source 1..299: mol_type = other RNA

SEQ ID NO: 43068 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggccggcgttagtgacaagagggacatcgagacgtcggaagagc

SEQ ID NO: 43069 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgccgttagtgacaagagggacatcgagacgtcggaagagc

SEQ ID NO: 43070 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgccagtgacaagagggacatcgagacgtcggaagagc

SEQ ID NO: 43071 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgccgacaagagggacatcgagacgtcggaagagc

SEQ ID NO: 43072 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacgccaagagggacatcgagacgtcggaagagc

SEQ ID NO: 43073 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggccagggacatcgagacgtcggaagagc

SEQ ID NO: 43074 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggccgacatcgagacgtcggaagagc

SEQ ID NO: 43075 - RNA, 299 nt, synthetic construct
  source 1..299: mol_type = other RNA
cgctcttccgcgtctcatgtacgtccagggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43076 - RNA, 299 nt, synthetic construct
  source 1..299: mol_type = other RNA
cgctcttccgcgtctcatgtacgtcgggcaggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43077 - RNA, 299 nt, synthetic construct
  source 1..299: mol_type = other RNA
cgctcttccgcgtctcatgtacgtcggggaccaggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43078 - RNA, 299 nt, synthetic construct
  source 1..299: mol_type = other RNA
cgctcttccgcgtctcatgtacgtcggggacgtccagcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43079 - RNA, 299 nt, synthetic construct
  source 1..299: mol_type = other RNA
cgctcttccgcgtctcatgtacgtcggggacgtccgccagagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43080 - RNA, 299 nt, synthetic construct
  source 1..299: mol_type = other RNA
cgctcttccgcgtctcatgtacgtcggggacgtccgcagccaggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43081 - RNA, 299 nt, synthetic construct
  source 1..299: mol_type = other RNA
cgctcttccgcgtctcatgtacgtcggggacgtccgcagcgtccagacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43082 - RNA, 299 nt, synthetic construct
  source 1..299: mol_type = other RNA
cgctcttccgcgtctcatgtacgtcggggacgtccgcagcgtcacacagcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43083 - RNA, 299 nt, synthetic construct; identical to SEQ ID NO: 43082
  source 1..299: mol_type = other RNA

SEQ ID NO: 43084 - RNA, 299 nt, synthetic construct
  source 1..299: mol_type = other RNA
cgctcttccgcgtctcatgtacgtcggggacgtccgcagcgtcacacagaagcagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43085 - RNA, 299 nt, synthetic construct
  source 1..299: mol_type = other RNA
cgctcttccgcgtctcatgtacgtcggggacgtccgcagcgtcacacagaagcatcagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43086 - RNA, 299 nt, synthetic construct
  source 1..299: mol_type = other RNA
cgctcttccgcgtctcatgtacgtcggggacgtccgcagcgtcacacagaagcatatccagcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43087 - RNA, 299 nt, synthetic construct; identical to SEQ ID NO: 43086
  source 1..299: mol_type = other RNA

SEQ ID NO: 43088 - RNA, 299 nt, synthetic construct
  source 1..299: mol_type = other RNA
cgctcttccgcgtctcatgtacgtcggggacgtccgcagcgtcacacagaagcatatccaggagcagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43089 - RNA, 299 nt, synthetic construct
  source 1..299: mol_type = other RNA
cgctcttccgcgtctcatgtacgtcggggacgtccgcagcgtcacacagaagcatatccaggagtggcagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43090 - RNA, 299 nt, synthetic construct
  source 1..299: mol_type = other RNA
cgctcttccgcgtctcatgtacgtcggggacgtccgcagcgtcacacagaagcatatccaggagtggggccagccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43091 - RNA, 299 nt, synthetic construct
  source 1..299: mol_type = other RNA
cgctcttccgcgtctcatgtacgtcggggacgtccgcagcgtcacacagaagcatatccaggagtggggcccacagttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43092 - RNA, 299 nt, synthetic construct
  source 1..299: mol_type = other RNA
cgctcttccgcgtctcatgtacgtcggggacgtccgcagcgtcacacagaagcatatccaggagtggggcccattccaggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43093 - RNA, 299 nt, synthetic construct
  source 1..299: mol_type = other RNA
cgctcttccgcgtctcatgtacgtcggggacgtccgcagcgtcacacagaagcatatccaggagtggggcccattcgaccagctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43094 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgcaggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43095 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgcagattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43096 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattcagggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43097 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggacagggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43098 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggccagagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43099 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcagccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43100 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccccagtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43101 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgccagaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43102 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaaccaggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43103 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgaccagctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43104 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctccagtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43105 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcccagattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43106 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattcaggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43107 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccagaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43108 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccagcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43109 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcaggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43110 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccagcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43111 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccagaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43112 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43113 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43114 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcagtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43115 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcaggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43116 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43117 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43118 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcagggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43119 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccagcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43120 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccagctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43121 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccagttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43122 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccagtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43123 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcaggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43124 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43125 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43126 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccagcgcctcctgcatgatgcgcggcccaaggagggagatgatcgccccttcttctggctctttgagaatgtggtggccatgggcgttagtgacaagagggacatcgagacgtcggaagagc

SEQ ID NO: 43127 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccagctcctgcatgatgcgcggcccaaggagggagatgatcgccccttcttctggctctttgagaatgtggtggccatgggcgttagtgacaagagggacatcgagacgtcggaagagc

SEQ ID NO: 43128 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccagctgcatgatgcgcggcccaaggagggagatgatcgccccttcttctggctctttgagaatgtggtggccatgggcgttagtgacaagagggacatcgagacgtcggaagagc

SEQ ID NO: 43129 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcagcatgatgcgcggcccaaggagggagatgatcgccccttcttctggctctttgagaatgtggtggccatgggcgttagtgacaagagggacatcgagacgtcggaagagc

SEQ ID NO: 43130 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcaggatgcgcggcccaaggagggagatgatcgccccttcttctggctctttgagaatgtggtggccatgggcgttagtgacaagagggacatcgagacgtcggaagagc

SEQ ID NO: 43131 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcaggcgcggcccaaggagggagatgatcgccccttcttctggctctttgagaatgtggtggccatgggcgttagtgacaagagggacatcgagacgtcggaagagc

SEQ ID NO: 43132 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcagcggcccaaggagggagatgatcgccccttcttctggctctttgagaatgtggtggccatgggcgttagtgacaagagggacatcgagacgtcggaagagc

SEQ ID NO: 43133 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcagcccaaggagggagatgatcgccccttcttctggctctttgagaatgtggtggccatgggcgttagtgacaagagggacatcgagacgtcggaagagc

SEQ ID NO: 43134 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccagaaggagggagatgatcgccccttcttctggctctttgagaatgtggtggccatgggcgttagtgacaagagggacatcgagacgtcggaagagc

SEQ ID NO: 43135 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcaggagggagatgatcgccccttcttctggctctttgagaatgtggtggccatgggcgttagtgacaagagggacatcgagacgtcggaagagc

SEQ ID NO: 43136 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcagggagatgatcgccccttcttctggctctttgagaatgtggtggccatgggcgttagtgacaagagggacatcgagacgtcggaagagc

SEQ ID NO: 43137 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacaggatgatcgccccttcttctggctctttgagaatgtggtggccatgggcgttagtgacaagagggacatcgagacgtcggaagagc

SEQ ID NO: 43138 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcaggatcgccccttcttctggctctttgagaatgtggtggccatgggcgttagtgacaagagggacatcgagacgtcggaagagc

SEQ ID NO: 43139 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcagcgccccttcttctggctctttgagaatgtggtggccatgggcgttagtgacaagagggacatcgagacgtcggaagagc

SEQ ID NO: 43140 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccagcccttcttctggctctttgagaatgtggtggccatgggcgttagtgacaagagggacatcgagacgtcggaagagc

SEQ ID NO: 43141 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccagttcttctggctctttgagaatgtggtggccatgggcgttagtgacaagagggacatcgagacgtcggaagagc

SEQ ID NO: 43142 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccagttctggctctttgagaatgtggtggccatgggcgttagtgacaagagggacatcgagacgtcggaagagc

SEQ ID NO: 43143 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccagtggctctttgagaatgtggtggccatgggcgttagtgacaagagggacatcgagacgtcggaagagc

SEQ ID NO: 43144 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcagctctttgagaatgtggtggccatgggcgttagtgacaagagggacatcgagacgtcggaagagc

SEQ ID NO: 43145 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccagtttgagaatgtggtggccatgggcgttagtgacaagagggacatcgagacgtcggaagagc

SEQ ID NO: 43146 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcaggagaatgtggtggccatgggcgttagtgacaagagggacatcgagacgtcggaagagc

SEQ ID NO: 43147 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcagaatgtggtggccatgggcgttagtgacaagagggacatcgagacgtcggaagagc

SEQ ID NO: 43148 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcaggtggtggccatgggcgttagtgacaagagggacatcgagacgtcggaagagc

SEQ ID NO: 43149 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcaggtggccatgggcgttagtgacaagagggacatcgagacgtcggaagagc

SEQ ID NO: 43150 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcaggccatgggcgttagtgacaagagggacatcgagacgtcggaagagc

SEQ ID NO: 43151 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccagatgggcgttagtgacaagagggacatcgagacgtcggaagagc

SEQ ID NO: 43152 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcagggcgttagtgacaagagggacatcgagacgtcggaagagc

SEQ ID NO: 43153 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccaggttagtgacaagagggacatcgagacgtcggaagagc

SEQ ID NO: 43154 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcagagtgacaagagggacatcgagacgtcggaagagc

SEQ ID NO: 43155 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcaggacaagagggacatcgagacgtcggaagagc

SEQ ID NO: 43156 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccagaagagggacatcgagacgtcggaagagc

SEQ ID NO: 43157 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcagagggacatcgagacgtcggaagagc

SEQ ID NO: 43158 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggcaggacatcgagacgtcggaagagc

SEQ ID NO: 43159 - RNA, 299 nt, synthetic construct
  source 1..299: mol_type = other RNA
cgctcttccgcgtctcatgtacgtccacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43160 - RNA, 299 nt, synthetic construct
  source 1..299: mol_type = other RNA
cgctcttccgcgtctcatgtacgtcgggcacgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43161 - RNA, 299 nt, synthetic construct
  source 1..299: mol_type = other RNA
cgctcttccgcgtctcatgtacgtcggggaccacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43162 - RNA, 299 nt, synthetic construct
  source 1..299: mol_type = other RNA
cgctcttccgcgtctcatgtacgtcggggacgtccaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43163 - RNA, 299 nt, synthetic construct
  source 1..299: mol_type = other RNA
cgctcttccgcgtctcatgtacgtcggggacgtccgccacagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43164 - RNA, 299 nt, synthetic construct
  source 1..299: mol_type = other RNA
cgctcttccgcgtctcatgtacgtcggggacgtccgcagccacgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43165 - RNA, 299 nt, synthetic construct
  source 1..299: mol_type = other RNA
cgctcttccgcgtctcatgtacgtcggggacgtccgcagcgtccacacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43166 - RNA, 299 nt, synthetic construct
  source 1..299: mol_type = other RNA
cgctcttccgcgtctcatgtacgtcggggacgtccgcagcgtcacacaccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43167 - RNA, 299 nt, synthetic construct
  source 1..299: mol_type = other RNA
cgctcttccgcgtctcatgtacgtcggggacgtccgcagcgtcacacagcacaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43168 - RNA, 299 nt, synthetic construct
  source 1..299: mol_type = other RNA
cgctcttccgcgtctcatgtacgtcggggacgtccgcagcgtcacacagaagcaccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43169 - RNA, 299 nt, synthetic construct
  source 1..299: mol_type = other RNA
cgctcttccgcgtctcatgtacgtcggggacgtccgcagcgtcacacagaagcatcacatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43170 - RNA, 299 nt, synthetic construct
  source 1..299: mol_type = other RNA
cgctcttccgcgtctcatgtacgtcggggacgtccgcagcgtcacacagaagcatatccaccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43171 - RNA, 299 nt, synthetic construct
  source 1..299: mol_type = other RNA
cgctcttccgcgtctcatgtacgtcggggacgtccgcagcgtcacacagaagcatatccagcacgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43172 - RNA, 299 nt, synthetic construct
  source 1..299: mol_type = other RNA
cgctcttccgcgtctcatgtacgtcggggacgtccgcagcgtcacacagaagcatatccaggagcactggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43173 - RNA, 299 nt, synthetic construct
  source 1..299: mol_type = other RNA
cgctcttccgcgtctcatgtacgtcggggacgtccgcagcgtcacacagaagcatatccaggagtggcacggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43174 - RNA, 299 nt, synthetic construct
  source 1..299: mol_type = other RNA
cgctcttccgcgtctcatgtacgtcggggacgtccgcagcgtcacacagaagcatatccaggagtggggccacccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43175 - RNA, 299 nt, synthetic construct
  source 1..299: mol_type = other RNA
cgctcttccgcgtctcatgtacgtcggggacgtccgcagcgtcacacagaagcatatccaggagtggggcccacacttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43176 - RNA, 299 nt, synthetic construct
  source 1..299: mol_type = other RNA
cgctcttccgcgtctcatgtacgtcggggacgtccgcagcgtcacacagaagcatatccaggagtggggcccattccacgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43177 - RNA, 299 nt, synthetic construct
  source 1..299: mol_type = other RNA
cgctcttccgcgtctcatgtacgtcggggacgtccgcagcgtcacacagaagcatatccaggagtggggcccattcgaccacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43178 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgcacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43179 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgcacattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43180 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattcacggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43181 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggacacggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43182 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggccacagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43183 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcacccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43184 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccccactgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43185 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgccacaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43186 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaaccacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43187 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgaccacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43188 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctccactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43189 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcccacattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43190 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattcacgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43191 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccacaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43192 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43193 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43194 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccaccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43195 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccacaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43196 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcacggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43197 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacacctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43198 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcactatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43199 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcacgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43200 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcacggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43201 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcacactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43202 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcacggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43203 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccaccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43204 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccacctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43205 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccacttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43206 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccactttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43207 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcacgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43208 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcacttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43209 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccactaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43210 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43211 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccacctcctgcatgatgcgcggcccaaggagggagatgatcgccccttcttctggctctttgagaatgtggtggccatgggcgttagtgacaagagggacatcgagacgtcggaagagc

SEQ ID NO: 43212 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccacctgcatgatgcgcggcccaaggagggagatgatcgccccttcttctggctctttgagaatgtggtggccatgggcgttagtgacaagagggacatcgagacgtcggaagagc

SEQ ID NO: 43213 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcaccatgatgcgcggcccaaggagggagatgatcgccccttcttctggctctttgagaatgtggtggccatgggcgttagtgacaagagggacatcgagacgtcggaagagc

SEQ ID NO: 43214 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcacgatgcgcggcccaaggagggagatgatcgccccttcttctggctctttgagaatgtggtggccatgggcgttagtgacaagagggacatcgagacgtcggaagagc

SEQ ID NO: 43215 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcacgcgcggcccaaggagggagatgatcgccccttcttctggctctttgagaatgtggtggccatgggcgttagtgacaagagggacatcgagacgtcggaagagc

SEQ ID NO: 43216 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcaccggcccaaggagggagatgatcgccccttcttctggctctttgagaatgtggtggccatgggcgttagtgacaagagggacatcgagacgtcggaagagc

SEQ ID NO: 43217 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcaccccaaggagggagatgatcgccccttcttctggctctttgagaatgtggtggccatgggcgttagtgacaagagggacatcgagacgtcggaagagc

SEQ ID NO: 43218 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccacaaggagggagatgatcgccccttcttctggctctttgagaatgtggtggccatgggcgttagtgacaagagggacatcgagacgtcggaagagc

SEQ ID NO: 43219 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcacgagggagatgatcgccccttcttctggctctttgagaatgtggtggccatgggcgttagtgacaagagggacatcgagacgtcggaagagc

SEQ ID NO: 43220 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcacggagatgatcgccccttcttctggctctttgagaatgtggtggccatgggcgttagtgacaagagggacatcgagacgtcggaagagc

SEQ ID NO: 43221 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacacgatgatcgccccttcttctggctctttgagaatgtggtggccatgggcgttagtgacaagagggacatcgagacgtcggaagagc

SEQ ID NO: 43222 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcacgatcgccccttcttctggctctttgagaatgtggtggccatgggcgttagtgacaagagggacatcgagacgtcggaagagc

SEQ ID NO: 43223 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcaccgccccttcttctggctctttgagaatgtggtggccatgggcgttagtgacaagagggacatcgagacgtcggaagagc

SEQ ID NO: 43224 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccaccccttcttctggctctttgagaatgtggtggccatgggcgttagtgacaagagggacatcgagacgtcggaagagc

SEQ ID NO: 43225 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccacttcttctggctctttgagaatgtggtggccatgggcgttagtgacaagagggacatcgagacgtcggaagagc

SEQ ID NO: 43226 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccacttctggctctttgagaatgtggtggccatgggcgttagtgacaagagggacatcgagacgtcggaagagc

SEQ ID NO: 43227 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccactggctctttgagaatgtggtggccatgggcgttagtgacaagagggacatcgagacgtcggaagagc

SEQ ID NO: 43228 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcacctctttgagaatgtggtggccatgggcgttagtgacaagagggacatcgagacgtcggaagagc

SEQ ID NO: 43229 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccactttgagaatgtggtggccatgggcgttagtgacaagagggacatcgagacgtcggaagagc

SEQ ID NO: 43230 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcacgagaatgtggtggccatgggcgttagtgacaagagggacatcgagacgtcggaagagc

SEQ ID NO: 43231 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcacaatgtggtggccatgggcgttagtgacaagagggacatcgagacgtcggaagagc

SEQ ID NO: 43232 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcacgtggtggccatgggcgttagtgacaagagggacatcgagacgtcggaagagc

SEQ ID NO: 43233 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcacgtggccatgggcgttagtgacaagagggacatcgagacgtcggaagagc

SEQ ID NO: 43234 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcacgccatgggcgttagtgacaagagggacatcgagacgtcggaagagc

SEQ ID NO: 43235 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccacatgggcgttagtgacaagagggacatcgagacgtcggaagagc

SEQ ID NO: 43236 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcacggcgttagtgacaagagggacatcgagacgtcggaagagc

SEQ ID NO: 43237 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccacgttagtgacaagagggacatcgagacgtcggaagagc

SEQ ID NO: 43238 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcacagtgacaagagggacatcgagacgtcggaagagc

SEQ ID NO: 43239 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcacgacaagagggacatcgagacgtcggaagagc

SEQ ID NO: 43240 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccacaagagggacatcgagacgtcggaagagc

SEQ ID NO: 43241 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcacagggacatcgagacgtcggaagagc

SEQ ID NO: 43242 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggcacgacatcgagacgtcggaagagc

SEQ ID NO: 43243 - RNA, 299 nt, synthetic construct
  source 1..299: mol_type = other RNA
cgctcttccgcgtctcatgtacgtcctgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43244 - RNA, 299 nt, synthetic construct
  source 1..299: mol_type = other RNA
cgctcttccgcgtctcatgtacgtcgggctggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43245 - RNA, 299 nt, synthetic construct
  source 1..299: mol_type = other RNA
cgctcttccgcgtctcatgtacgtcggggacctggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43246 - RNA, 299 nt, synthetic construct
  source 1..299: mol_type = other RNA
cgctcttccgcgtctcatgtacgtcggggacgtcctgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43247 - RNA, 299 nt, synthetic construct
  source 1..299: mol_type = other RNA
cgctcttccgcgtctcatgtacgtcggggacgtccgcctgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43248 - RNA, 299 nt, synthetic construct
  source 1..299: mol_type = other RNA
cgctcttccgcgtctcatgtacgtcggggacgtccgcagcctggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43249 - RNA, 299 nt, synthetic construct
  source 1..299: mol_type = other RNA
cgctcttccgcgtctcatgtacgtcggggacgtccgcagcgtcctgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43250 - RNA, 299 nt, synthetic construct
  source 1..299: mol_type = other RNA
cgctcttccgcgtctcatgtacgtcggggacgtccgcagcgtcacactgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43251 - RNA, 299 nt, synthetic construct
  source 1..299: mol_type = other RNA
cgctcttccgcgtctcatgtacgtcggggacgtccgcagcgtcacacagctgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43252 - RNA, 299 nt, synthetic construct
  source 1..299: mol_type = other RNA
cgctcttccgcgtctcatgtacgtcggggacgtccgcagcgtcacacagaagctgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43253 - RNA, 299 nt, synthetic construct
  source 1..299: mol_type = other RNA
cgctcttccgcgtctcatgtacgtcggggacgtccgcagcgtcacacagaagcatctgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43254 - RNA, 299 nt, synthetic construct
  source 1..299: mol_type = other RNA
cgctcttccgcgtctcatgtacgtcggggacgtccgcagcgtcacacagaagcatatcctgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43255 - RNA, 299 nt, synthetic construct
  source 1..299: mol_type = other RNA
cgctcttccgcgtctcatgtacgtcggggacgtccgcagcgtcacacagaagcatatccagctggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43256 - RNA, 299 nt, synthetic construct
  source 1..299: mol_type = other RNA
cgctcttccgcgtctcatgtacgtcggggacgtccgcagcgtcacacagaagcatatccaggagctgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43257 - RNA, 299 nt, synthetic construct
  source 1..299: mol_type = other RNA
cgctcttccgcgtctcatgtacgtcggggacgtccgcagcgtcacacagaagcatatccaggagtggctgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43258 - RNA, 299 nt, synthetic construct
  source 1..299: mol_type = other RNA
cgctcttccgcgtctcatgtacgtcggggacgtccgcagcgtcacacagaagcatatccaggagtggggcctgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43259 - RNA, 299 nt, synthetic construct
  source 1..299: mol_type = other RNA
cgctcttccgcgtctcatgtacgtcggggacgtccgcagcgtcacacagaagcatatccaggagtggggcccactgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43260 - RNA, 299 nt, synthetic construct
  source 1..299: mol_type = other RNA
cgctcttccgcgtctcatgtacgtcggggacgtccgcagcgtcacacagaagcatatccaggagtggggcccattcctggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43261 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43262 - RNA, 299 nt, synthetic construct; identical to SEQ ID NO: 43261
  source 1..299: mol_type = other RNA

SEQ ID NO: 43263 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgctgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43264 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattctgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43265 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggactgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43266 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcctgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43267 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtctgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43268 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccctgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43269 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcctgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43270 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacctggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43271 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43272 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcctgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43273 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccctgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43274 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattctggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43275 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcctgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43276 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacctgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43277 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctctggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43278 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccctgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43279 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcctgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43280 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagctgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43281 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43282 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttctgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43283 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatctggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43284 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagctgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43285 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtctgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43286 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactctgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43287 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcctgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43288 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43289 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcctgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43290 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcctgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43291 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttctggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43292 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagctgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43293 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcctgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43294 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacctgcgcctcctgcatgatgcgcggcccaaggagggagatgatcgccccttcttctggctctttgagaatgtggtggccatgggcgttagtgacaagagggacatcgagacgtcggaagagc

SEQ ID NO: 43295 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctgctcctgcatgatgcgcggcccaaggagggagatgatcgccccttcttctggctctttgagaatgtggtggccatgggcgttagtgacaagagggacatcgagacgtcggaagagc

SEQ ID NO: 43296 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgctgcatgatgcgcggcccaaggagggagatgatcgccccttcttctggctctttgagaatgtggtggccatgggcgttagtgacaagagggacatcgagacgtcggaagagc

SEQ ID NO: 43297 - RNA, 299 nt, synthetic construct; identical to SEQ ID NO: 43296
  source 1..299: mol_type = other RNA

SEQ ID NO: 43298 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatctggatgcgcggcccaaggagggagatgatcgccccttcttctggctctttgagaatgtggtggccatgggcgttagtgacaagagggacatcgagacgtcggaagagc

SEQ ID NO: 43299 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatctggcgcggcccaaggagggagatgatcgccccttcttctggctctttgagaatgtggtggccatgggcgttagtgacaagagggacatcgagacgtcggaagagc

SEQ ID NO: 43300 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgctgcggcccaaggagggagatgatcgccccttcttctggctctttgagaatgtggtggccatgggcgttagtgacaagagggacatcgagacgtcggaagagc

SEQ ID NO: 43301 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggctgcccaaggagggagatgatcgccccttcttctggctctttgagaatgtggtggccatgggcgttagtgacaagagggacatcgagacgtcggaagagc

SEQ ID NO: 43302 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccctgaaggagggagatgatcgccccttcttctggctctttgagaatgtggtggccatgggcgttagtgacaagagggacatcgagacgtcggaagagc

SEQ ID NO: 43303 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagctggagggagatgatcgccccttcttctggctctttgagaatgtggtggccatgggcgttagtgacaagagggacatcgagacgtcggaagagc

SEQ ID NO: 43304 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagctgggagatgatcgccccttcttctggctctttgagaatgtggtggccatgggcgttagtgacaagagggacatcgagacgtcggaagagc

SEQ ID NO: 43305 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggactggatgatcgccccttcttctggctctttgagaatgtggtggccatgggcgttagtgacaagagggacatcgagacgtcggaagagc

SEQ ID NO: 43306 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatctggatcgccccttcttctggctctttgagaatgtggtggccatgggcgttagtgacaagagggacatcgagacgtcggaagagc

SEQ ID NO: 43307 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatctgcgccccttcttctggctctttgagaatgtggtggccatgggcgttagtgacaagagggacatcgagacgtcggaagagc

SEQ ID NO: 43308 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcctgcccttcttctggctctttgagaatgtggtggccatgggcgttagtgacaagagggacatcgagacgtcggaagagc

SEQ ID NO: 43309 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccctgttcttctggctctttgagaatgtggtggccatgggcgttagtgacaagagggacatcgagacgtcggaagagc

SEQ ID NO: 43310 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcctgttctggctctttgagaatgtggtggccatgggcgttagtgacaagagggacatcgagacgtcggaagagc

SEQ ID NO: 43311 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcctgtggctctttgagaatgtggtggccatgggcgttagtgacaagagggacatcgagacgtcggaagagc

SEQ ID NO: 43312 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctgctctttgagaatgtggtggccatgggcgttagtgacaagagggacatcgagacgtcggaagagc

SEQ ID NO: 43313 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcctgtttgagaatgtggtggccatgggcgttagtgacaagagggacatcgagacgtcggaagagc

SEQ ID NO: 43314 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttctggagaatgtggtggccatgggcgttagtgacaagagggacatcgagacgtcggaagagc

SEQ ID NO: 43315 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagctgaatgtggtggccatgggcgttagtgacaagagggacatcgagacgtcggaagagc

SEQ ID NO: 43316 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatctggtggtggccatgggcgttagtgacaagagggacatcgagacgtcggaagagc

SEQ ID NO: 43317 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgctggtggccatgggcgttagtgacaagagggacatcgagacgtcggaagagc

SEQ ID NO: 43318 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgctggccatgggcgttagtgacaagagggacatcgagacgtcggaagagc

SEQ ID NO: 43319 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccctgatgggcgttagtgacaagagggacatcgagacgtcggaagagc

SEQ ID NO: 43320 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgctgggcgttagtgacaagagggacatcgagacgtcggaagagc

SEQ ID NO: 43321 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcctggttagtgacaagagggacatcgagacgtcggaagagc

SEQ ID NO: 43322 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttctgagtgacaagagggacatcgagacgtcggaagagc

SEQ ID NO: 43323 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtctggacaagagggacatcgagacgtcggaagagc

SEQ ID NO: 43324 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacctgaagagggacatcgagacgtcggaagagc

SEQ ID NO: 43325 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagctgagggacatcgagacgtcggaagagc

SEQ ID NO: 43326 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggctggacatcgagacgtcggaagagc

SEQ ID NO: 43327 - RNA, 299 nt, synthetic construct
  source 1..299: mol_type = other RNA
cgctcttccgcgtctcatgtacgtcctcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43328 - RNA, 299 nt, synthetic construct
  source 1..299: mol_type = other RNA
cgctcttccgcgtctcatgtacgtcgggctcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43329 - RNA, 299 nt, synthetic construct
  source 1..299: mol_type = other RNA
cgctcttccgcgtctcatgtacgtcggggacctcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43330 - RNA, 299 nt, synthetic construct
  source 1..299: mol_type = other RNA
cgctcttccgcgtctcatgtacgtcggggacgtcctccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43331 - RNA, 299 nt, synthetic construct
  source 1..299: mol_type = other RNA
cgctcttccgcgtctcatgtacgtcggggacgtccgcctcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43332 - RNA, 299 nt, synthetic construct
  source 1..299: mol_type = other RNA
cgctcttccgcgtctcatgtacgtcggggacgtccgcagcctcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43333 - RNA, 299 nt, synthetic construct
  source 1..299: mol_type = other RNA
cgctcttccgcgtctcatgtacgtcggggacgtccgcagcgtcctcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43334 - RNA, 299 nt, synthetic construct
  source 1..299: mol_type = other RNA
cgctcttccgcgtctcatgtacgtcggggacgtccgcagcgtcacactccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43335 - RNA, 299 nt, synthetic construct
  source 1..299: mol_type = other RNA
cgctcttccgcgtctcatgtacgtcggggacgtccgcagcgtcacacagctcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43336 - RNA, 299 nt, synthetic construct
  source 1..299: mol_type = other RNA
cgctcttccgcgtctcatgtacgtcggggacgtccgcagcgtcacacagaagctccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43337 - RNA, 299 nt, synthetic construct
  source 1..299: mol_type = other RNA
cgctcttccgcgtctcatgtacgtcggggacgtccgcagcgtcacacagaagcatctcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43338 - RNA, 299 nt, synthetic construct
  source 1..299: mol_type = other RNA
cgctcttccgcgtctcatgtacgtcggggacgtccgcagcgtcacacagaagcatatcctccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43339 - RNA, 299 nt, synthetic construct
  source 1..299: mol_type = other RNA
cgctcttccgcgtctcatgtacgtcggggacgtccgcagcgtcacacagaagcatatccagctcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43340 - RNA, 299 nt, synthetic construct
  source 1..299: mol_type = other RNA
cgctcttccgcgtctcatgtacgtcggggacgtccgcagcgtcacacagaagcatatccaggagctctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43341 - RNA, 299 nt, synthetic construct
  source 1..299: mol_type = other RNA
cgctcttccgcgtctcatgtacgtcggggacgtccgcagcgtcacacagaagcatatccaggagtggctcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43342 - RNA, 299 nt, synthetic construct
  source 1..299: mol_type = other RNA
cgctcttccgcgtctcatgtacgtcggggacgtccgcagcgtcacacagaagcatatccaggagtggggcctcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43343 - RNA, 299 nt, synthetic construct
  source 1..299: mol_type = other RNA
cgctcttccgcgtctcatgtacgtcggggacgtccgcagcgtcacacagaagcatatccaggagtggggcccactcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43344 - RNA, 299 nt, synthetic construct
  source 1..299: mol_type = other RNA
cgctcttccgcgtctcatgtacgtcggggacgtccgcagcgtcacacagaagcatatccaggagtggggcccattcctcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43345 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43346 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgctcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43347 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgctcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43348 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattctcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43349 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggactcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43350 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcctcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43351 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtctcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43352 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccctctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43353 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcctcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43354 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacctcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43355 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43356 - RNA, 299 nt, synthetic construct; identical to SEQ ID NO: 43355
  source 1..299: mol_type = other RNA

SEQ ID NO: 43357 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccctcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43358 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattctcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43359 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcctcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43360 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacctccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43361 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctctcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43362 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccctccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43363 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcctcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43364 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagctcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43365 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43366 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttctctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43367 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatctcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43368 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagctcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43369 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtctcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43370 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactctcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43371 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcctccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43372 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43373 - RNA, 299 nt, synthetic construct; identical to SEQ ID NO: 43372
  source 1..299: mol_type = other RNA

SEQ ID NO: 43374 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcctctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43375 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttctcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43376 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagctcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43377 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcctctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43378 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacctccgcctcctgcatgatgcgcggcccaaggagggagatgatcgccccttcttctggctctttgagaatgtggtggccatgggcgttagtgacaagagggacatcgagacgtcggaagagc

SEQ ID NO: 43379 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctcctgcatgatgcgcggcccaaggagggagatgatcgccccttcttctggctctttgagaatgtggtggccatgggcgttagtgacaagagggacatcgagacgtcggaagagc

SEQ ID NO: 43380 - RNA, 299 nt, synthetic construct; identical to SEQ ID NO: 43379
  source 1..299: mol_type = other RNA

SEQ ID NO: 43381 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgctccatgatgcgcggcccaaggagggagatgatcgccccttcttctggctctttgagaatgtggtggccatgggcgttagtgacaagagggacatcgagacgtcggaagagc

SEQ ID NO: 43382 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatctcgatgcgcggcccaaggagggagatgatcgccccttcttctggctctttgagaatgtggtggccatgggcgttagtgacaagagggacatcgagacgtcggaagagc

SEQ ID NO: 43383 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatctcgcgcggcccaaggagggagatgatcgccccttcttctggctctttgagaatgtggtggccatgggcgttagtgacaagagggacatcgagacgtcggaagagc

SEQ ID NO: 43384 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgctccggcccaaggagggagatgatcgccccttcttctggctctttgagaatgtggtggccatgggcgttagtgacaagagggacatcgagacgtcggaagagc

SEQ ID NO: 43385 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggctccccaaggagggagatgatcgccccttcttctggctctttgagaatgtggtggccatgggcgttagtgacaagagggacatcgagacgtcggaagagc

SEQ ID NO: 43386 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccctcaaggagggagatgatcgccccttcttctggctctttgagaatgtggtggccatgggcgttagtgacaagagggacatcgagacgtcggaagagc

SEQ ID NO: 43387 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagctcgagggagatgatcgccccttcttctggctctttgagaatgtggtggccatgggcgttagtgacaagagggacatcgagacgtcggaagagc

SEQ ID NO: 43388 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagctcggagatgatcgccccttcttctggctctttgagaatgtggtggccatgggcgttagtgacaagagggacatcgagacgtcggaagagc

SEQ ID NO: 43389 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggactcgatgatcgccccttcttctggctctttgagaatgtggtggccatgggcgttagtgacaagagggacatcgagacgtcggaagagc

SEQ ID NO: 43390 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatctcgatcgccccttcttctggctctttgagaatgtggtggccatgggcgttagtgacaagagggacatcgagacgtcggaagagc

SEQ ID NO: 43391 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatctccgccccttcttctggctctttgagaatgtggtggccatgggcgttagtgacaagagggacatcgagacgtcggaagagc

SEQ ID NO: 43392 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcctccccttcttctggctctttgagaatgtggtggccatgggcgttagtgacaagagggacatcgagacgtcggaagagc

SEQ ID NO: 43393 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccctcttcttctggctctttgagaatgtggtggccatgggcgttagtgacaagagggacatcgagacgtcggaagagc

SEQ ID NO: 43394 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcctcttctggctctttgagaatgtggtggccatgggcgttagtgacaagagggacatcgagacgtcggaagagc

SEQ ID NO: 43395 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcctctggctctttgagaatgtggtggccatgggcgttagtgacaagagggacatcgagacgtcggaagagc

SEQ ID NO: 43396 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcctctttgagaatgtggtggccatgggcgttagtgacaagagggacatcgagacgtcggaagagc

SEQ ID NO: 43397 - RNA, 299 nt, synthetic construct; identical to SEQ ID NO: 43396
  source 1..299: mol_type = other RNA

SEQ ID NO: 43398 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttctcgagaatgtggtggccatgggcgttagtgacaagagggacatcgagacgtcggaagagc

SEQ ID NO: 43399 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagctcaatgtggtggccatgggcgttagtgacaagagggacatcgagacgtcggaagagc

SEQ ID NO: 43400 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatctcgtggtggccatgggcgttagtgacaagagggacatcgagacgtcggaagagc

SEQ ID NO: 43401 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgctcgtggccatgggcgttagtgacaagagggacatcgagacgtcggaagagc

SEQ ID NO: 43402 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgctcgccatgggcgttagtgacaagagggacatcgagacgtcggaagagc

SEQ ID NO: 43403 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccctcatgggcgttagtgacaagagggacatcgagacgtcggaagagc

SEQ ID NO: 43404 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgctcggcgttagtgacaagagggacatcgagacgtcggaagagc

SEQ ID NO: 43405 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcctcgttagtgacaagagggacatcgagacgtcggaagagc

SEQ ID NO: 43406 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttctcagtgacaagagggacatcgagacgtcggaagagc

SEQ ID NO: 43407 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtctcgacaagagggacatcgagacgtcggaagagc

SEQ ID NO: 43408 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacctcaagagggacatcgagacgtcggaagagc

SEQ ID NO: 43409 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagctcagggacatcgagacgtcggaagagc

SEQ ID NO: 43410 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggctcgacatcgagacgtcggaagagc

SEQ ID NO: 43411 - RNA, 299 nt, synthetic construct
  source 1..299: mol_type = other RNA
cgctcttccgcgtctcatgtacgtccggggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43412 - RNA, 299 nt, synthetic construct
  source 1..299: mol_type = other RNA
cgctcttccgcgtctcatgtacgtcgggcgggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43413 - RNA, 299 nt, synthetic construct
  source 1..299: mol_type = other RNA
cgctcttccgcgtctcatgtacgtcggggaccgggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43414 - RNA, 299 nt, synthetic construct
  source 1..299: mol_type = other RNA
cgctcttccgcgtctcatgtacgtcggggacgtccggcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43415 - RNA, 299 nt, synthetic construct
  source 1..299: mol_type = other RNA
cgctcttccgcgtctcatgtacgtcggggacgtccgccggagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43416 - RNA, 299 nt, synthetic construct
  source 1..299: mol_type = other RNA
cgctcttccgcgtctcatgtacgtcggggacgtccgcagccgggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43417 - RNA, 299 nt, synthetic construct
  source 1..299: mol_type = other RNA
cgctcttccgcgtctcatgtacgtcggggacgtccgcagcgtccggacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43418 - RNA, 299 nt, synthetic construct
  source 1..299: mol_type = other RNA
cgctcttccgcgtctcatgtacgtcggggacgtccgcagcgtcacacggcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43419 - RNA, 299 nt, synthetic construct
  source 1..299: mol_type = other RNA
cgctcttccgcgtctcatgtacgtcggggacgtccgcagcgtcacacagcggaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43420 - RNA, 299 nt, synthetic construct
  source 1..299: mol_type = other RNA
cgctcttccgcgtctcatgtacgtcggggacgtccgcagcgtcacacagaagcggcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43421 - RNA, 299 nt, synthetic construct
  source 1..299: mol_type = other RNA
cgctcttccgcgtctcatgtacgtcggggacgtccgcagcgtcacacagaagcatcggatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43422 - RNA, 299 nt, synthetic construct
  source 1..299: mol_type = other RNA
cgctcttccgcgtctcatgtacgtcggggacgtccgcagcgtcacacagaagcatatccggcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43423 - RNA, 299 nt, synthetic construct
  source 1..299: mol_type = other RNA
cgctcttccgcgtctcatgtacgtcggggacgtccgcagcgtcacacagaagcatatccagcgggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43424 - RNA, 299 nt, synthetic construct
  source 1..299: mol_type = other RNA
cgctcttccgcgtctcatgtacgtcggggacgtccgcagcgtcacacagaagcatatccaggagcggtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43425 - RNA, 299 nt, synthetic construct
  source 1..299: mol_type = other RNA
cgctcttccgcgtctcatgtacgtcggggacgtccgcagcgtcacacagaagcatatccaggagtggcggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43426 - RNA, 299 nt, synthetic construct
  source 1..299: mol_type = other RNA
cgctcttccgcgtctcatgtacgtcggggacgtccgcagcgtcacacagaagcatatccaggagtggggccggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43427 - RNA, 299 nt, synthetic construct
  source 1..299: mol_type = other RNA
cgctcttccgcgtctcatgtacgtcggggacgtccgcagcgtcacacagaagcatatccaggagtggggcccacggttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43428 - RNA, 299 nt, synthetic construct
  source 1..299: mol_type = other RNA
cgctcttccgcgtctcatgtacgtcggggacgtccgcagcgtcacacagaagcatatccaggagtggggcccattccgggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43429 - RNA, 299 nt, synthetic construct
  source 1..299: mol_type = other RNA
cgctcttccgcgtctcatgtacgtcggggacgtccgcagcgtcacacagaagcatatccaggagtggggcccattcgaccggctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43430 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgcgggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43431 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgcggattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43432 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattcggggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43433 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggacggggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43434 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggccggagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43435 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcggccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43436 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccccggtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43437 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgccggaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43438 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaaccgggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43439 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgaccggctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43440 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctccggtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43441 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcccggattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43442 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattcgggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43443 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccggaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43444 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccggcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43445 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcgggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43446 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccggcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43447 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccggaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43448 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcggggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43449 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacggctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43450 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcggtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43451 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcgggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43452 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcggggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43453 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcggactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43454 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcggggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43455 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccggcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43456 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccggctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43457 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccggttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43458 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccggtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43459 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcgggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43460 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcggttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43461 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccggtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43462 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccggcgcctcctgcatgatgcgcggcccaaggagggagatgatcgccccttcttctggctctttgagaatgtggtggccatgggcgttagtgacaagagggacatcgagacgtcggaagagc

SEQ ID NO: 43463 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccggctcctgcatgatgcgcggcccaaggagggagatgatcgccccttcttctggctctttgagaatgtggtggccatgggcgttagtgacaagagggacatcgagacgtcggaagagc

SEQ ID NO: 43464 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccggctgcatgatgcgcggcccaaggagggagatgatcgccccttcttctggctctttgagaatgtggtggccatgggcgttagtgacaagagggacatcgagacgtcggaagagc

SEQ ID NO: 43465 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcggcatgatgcgcggcccaaggagggagatgatcgccccttcttctggctctttgagaatgtggtggccatgggcgttagtgacaagagggacatcgagacgtcggaagagc

SEQ ID NO: 43466 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcgggatgcgcggcccaaggagggagatgatcgccccttcttctggctctttgagaatgtggtggccatgggcgttagtgacaagagggacatcgagacgtcggaagagc

SEQ ID NO: 43467 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcgggcgcggcccaaggagggagatgatcgccccttcttctggctctttgagaatgtggtggccatgggcgttagtgacaagagggacatcgagacgtcggaagagc

SEQ ID NO: 43468 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcggcccaaggagggagatgatcgccccttcttctggctctttgagaatgtggtggccatgggcgttagtgacaagagggacatcgagacgtcggaagagc

SEQ ID NO: 43469 - RNA, 299 nt, synthetic construct; identical to SEQ ID NO: 43468
  source 1..299: mol_type = other RNA

SEQ ID NO: 43470 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccggaaggagggagatgatcgccccttcttctggctctttgagaatgtggtggccatgggcgttagtgacaagagggacatcgagacgtcggaagagc

SEQ ID NO: 43471 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcgggagggagatgatcgccccttcttctggctctttgagaatgtggtggccatgggcgttagtgacaagagggacatcgagacgtcggaagagc

SEQ ID NO: 43472 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcggggagatgatcgccccttcttctggctctttgagaatgtggtggccatgggcgttagtgacaagagggacatcgagacgtcggaagagc

SEQ ID NO: 43473 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacgggatgatcgccccttcttctggctctttgagaatgtggtggccatgggcgttagtgacaagagggacatcgagacgtcggaagagc

SEQ ID NO: 43474 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcgggatcgccccttcttctggctctttgagaatgtggtggccatgggcgttagtgacaagagggacatcgagacgtcggaagagc

SEQ ID NO: 43475 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcggcgccccttcttctggctctttgagaatgtggtggccatgggcgttagtgacaagagggacatcgagacgtcggaagagc

SEQ ID NO: 43476 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccggcccttcttctggctctttgagaatgtggtggccatgggcgttagtgacaagagggacatcgagacgtcggaagagc

SEQ ID NO: 43477 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccggttcttctggctctttgagaatgtggtggccatgggcgttagtgacaagagggacatcgagacgtcggaagagc

SEQ ID NO: 43478 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccggttctggctctttgagaatgtggtggccatgggcgttagtgacaagagggacatcgagacgtcggaagagc

SEQ ID NO: 43479 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccggtggctctttgagaatgtggtggccatgggcgttagtgacaagagggacatcgagacgtcggaagagc

SEQ ID NO: 43480 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcggctctttgagaatgtggtggccatgggcgttagtgacaagagggacatcgagacgtcggaagagc

SEQ ID NO: 43481 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccggtttgagaatgtggtggccatgggcgttagtgacaagagggacatcgagacgtcggaagagc

SEQ ID NO: 43482 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcgggagaatgtggtggccatgggcgttagtgacaagagggacatcgagacgtcggaagagc

SEQ ID NO: 43483 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcggaatgtggtggccatgggcgttagtgacaagagggacatcgagacgtcggaagagc

SEQ ID NO: 43484 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcgggtggtggccatgggcgttagtgacaagagggacatcgagacgtcggaagagc

SEQ ID NO: 43485 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcgggtggccatgggcgttagtgacaagagggacatcgagacgtcggaagagc

SEQ ID NO: 43486 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcgggccatgggcgttagtgacaagagggacatcgagacgtcggaagagc

SEQ ID NO: 43487 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccggatgggcgttagtgacaagagggacatcgagacgtcggaagagc

SEQ ID NO: 43488 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcggggcgttagtgacaagagggacatcgagacgtcggaagagc

SEQ ID NO: 43489 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccgggttagtgacaagagggacatcgagacgtcggaagagc

SEQ ID NO: 43490 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcggagtgacaagagggacatcgagacgtcggaagagc

SEQ ID NO: 43491 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcgggacaagagggacatcgagacgtcggaagagc

SEQ ID NO: 43492 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccggaagagggacatcgagacgtcggaagagc

SEQ ID NO: 43493 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcggagggacatcgagacgtcggaagagc

SEQ ID NO: 43494 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggcgggacatcgagacgtcggaagagc

SEQ ID NO: 43495 - RNA, 299 nt, synthetic construct
  source 1..299: mol_type = other RNA
cgctcttccgcgtctcatgtacgtccgcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43496 - RNA, 299 nt, synthetic construct
  source 1..299: mol_type = other RNA
cgctcttccgcgtctcatgtacgtcgggcgcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43497 - RNA, 299 nt, synthetic construct
  source 1..299: mol_type = other RNA
cgctcttccgcgtctcatgtacgtcggggaccgcgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43498 - RNA, 299 nt, synthetic construct
  source 1..299: mol_type = other RNA
cgctcttccgcgtctcatgtacgtcggggacgtccgccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43499 - RNA, 299 nt, synthetic construct; identical to SEQ ID NO: 43498
  source 1..299: mol_type = other RNA

SEQ ID NO: 43500 - RNA, 299 nt, synthetic construct
  source 1..299: mol_type = other RNA
cgctcttccgcgtctcatgtacgtcggggacgtccgcagccgcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43501 - RNA, 299 nt, synthetic construct
  source 1..299: mol_type = other RNA
cgctcttccgcgtctcatgtacgtcggggacgtccgcagcgtccgcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43502 - RNA, 299 nt, synthetic construct
  source 1..299: mol_type = other RNA
cgctcttccgcgtctcatgtacgtcggggacgtccgcagcgtcacacgccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43503 - RNA, 299 nt, synthetic construct
  source 1..299: mol_type = other RNA
cgctcttccgcgtctcatgtacgtcggggacgtccgcagcgtcacacagcgcaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43504 - RNA, 299 nt, synthetic construct
  source 1..299: mol_type = other RNA
cgctcttccgcgtctcatgtacgtcggggacgtccgcagcgtcacacagaagcgccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43505 - RNA, 299 nt, synthetic construct
  source 1..299: mol_type = other RNA
cgctcttccgcgtctcatgtacgtcggggacgtccgcagcgtcacacagaagcatcgcatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43506 - RNA, 299 nt, synthetic construct
  source 1..299: mol_type = other RNA
cgctcttccgcgtctcatgtacgtcggggacgtccgcagcgtcacacagaagcatatccgccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43507 - RNA, 299 nt, synthetic construct
  source 1..299: mol_type = other RNA
cgctcttccgcgtctcatgtacgtcggggacgtccgcagcgtcacacagaagcatatccagcgcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43508 - RNA, 299 nt, synthetic construct
  source 1..299: mol_type = other RNA
cgctcttccgcgtctcatgtacgtcggggacgtccgcagcgtcacacagaagcatatccaggagcgctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43509 - RNA, 299 nt, synthetic construct
  source 1..299: mol_type = other RNA
cgctcttccgcgtctcatgtacgtcggggacgtccgcagcgtcacacagaagcatatccaggagtggcgcggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43510 - RNA, 299 nt, synthetic construct
  source 1..299: mol_type = other RNA
cgctcttccgcgtctcatgtacgtcggggacgtccgcagcgtcacacagaagcatatccaggagtggggccgcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43511 - RNA, 299 nt, synthetic construct
  source 1..299: mol_type = other RNA
cgctcttccgcgtctcatgtacgtcggggacgtccgcagcgtcacacagaagcatatccaggagtggggcccacgcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43512 - RNA, 299 nt, synthetic construct
  source 1..299: mol_type = other RNA
cgctcttccgcgtctcatgtacgtcggggacgtccgcagcgtcacacagaagcatatccaggagtggggcccattccgcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43513 - RNA, 299 nt, synthetic construct
  source 1..299: mol_type = other RNA
cgctcttccgcgtctcatgtacgtcggggacgtccgcagcgtcacacagaagcatatccaggagtggggcccattcgaccgcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43514 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgcgcgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43515 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgcgcattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43516 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattcgcggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43517 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggacgcggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43518 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggccgcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43519 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcgcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43520 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccccgctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43521 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgccgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43522 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaaccgcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43523 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgaccgcctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43524 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctccgctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43525 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcccgcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43526 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattcgcgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43527 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccgcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43528 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccgccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43529 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcgcgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43530 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43531 - RNA, 299 nt, synthetic construct; identical to SEQ ID NO: 43530
  source 1..299: mol_type = other RNA

SEQ ID NO: 43532 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcgcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43533 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacgcctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43534 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttcgctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43535 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcgcgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43536 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcgcggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43537 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcgcactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43538 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcgcggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43539 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43540 - RNA, 299 nt, synthetic construct; identical to SEQ ID NO: 43539
  source 1..299: mol_type = other RNA

SEQ ID NO: 43541 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccgcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43542 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttccgctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43543 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcgcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43544 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcgcttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43545 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccgctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43546 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccgcctcctgcatgatgcgcggcccaaggagggagatgatcgccccttcttctggctctttgagaatgtggtggccatgggcgttagtgacaagagggacatcgagacgtcggaagagc

SEQ ID NO: 43547 - RNA, 299 nt, synthetic construct; identical to SEQ ID NO: 43546
  source 1..299: mol_type = other RNA

SEQ ID NO: 43548 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccgcctgcatgatgcgcggcccaaggagggagatgatcgccccttcttctggctctttgagaatgtggtggccatgggcgttagtgacaagagggacatcgagacgtcggaagagc

SEQ ID NO: 43549 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcgccatgatgcgcggcccaaggagggagatgatcgccccttcttctggctctttgagaatgtggtggccatgggcgttagtgacaagagggacatcgagacgtcggaagagc

SEQ ID NO: 43550 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcgcgatgcgcggcccaaggagggagatgatcgccccttcttctggctctttgagaatgtggtggccatgggcgttagtgacaagagggacatcgagacgtcggaagagc

SEQ ID NO: 43551 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcgcgcgcggcccaaggagggagatgatcgccccttcttctggctctttgagaatgtggtggccatgggcgttagtgacaagagggacatcgagacgtcggaagagc

SEQ ID NO: 43552 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcgccggcccaaggagggagatgatcgccccttcttctggctctttgagaatgtggtggccatgggcgttagtgacaagagggacatcgagacgtcggaagagc

SEQ ID NO: 43553 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcgccccaaggagggagatgatcgccccttcttctggctctttgagaatgtggtggccatgggcgttagtgacaagagggacatcgagacgtcggaagagc

SEQ ID NO: 43554 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccgcaaggagggagatgatcgccccttcttctggctctttgagaatgtggtggccatgggcgttagtgacaagagggacatcgagacgtcggaagagc

SEQ ID NO: 43555 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcgcgagggagatgatcgccccttcttctggctctttgagaatgtggtggccatgggcgttagtgacaagagggacatcgagacgtcggaagagc

SEQ ID NO: 43556 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcgcggagatgatcgccccttcttctggctctttgagaatgtggtggccatgggcgttagtgacaagagggacatcgagacgtcggaagagc

SEQ ID NO: 43557 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacgcgatgatcgccccttcttctggctctttgagaatgtggtggccatgggcgttagtgacaagagggacatcgagacgtcggaagagc

SEQ ID NO: 43558 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcgcgatcgccccttcttctggctctttgagaatgtggtggccatgggcgttagtgacaagagggacatcgagacgtcggaagagc

SEQ ID NO: 43559 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccgccccttcttctggctctttgagaatgtggtggccatgggcgttagtgacaagagggacatcgagacgtcggaagagc

SEQ ID NO: 43560 - RNA, 299 nt, synthetic construct; identical to SEQ ID NO: 43559
  source 1..299: mol_type = other RNA

SEQ ID NO: 43561 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccgcttcttctggctctttgagaatgtggtggccatgggcgttagtgacaagagggacatcgagacgtcggaagagc

SEQ ID NO: 43562 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccgcttctggctctttgagaatgtggtggccatgggcgttagtgacaagagggacatcgagacgtcggaagagc

SEQ ID NO: 43563 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttccgctggctctttgagaatgtggtggccatgggcgttagtgacaagagggacatcgagacgtcggaagagc

SEQ ID NO: 43564 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcgcctctttgagaatgtggtggccatgggcgttagtgacaagagggacatcgagacgtcggaagagc

SEQ ID NO: 43565 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctccgctttgagaatgtggtggccatgggcgttagtgacaagagggacatcgagacgtcggaagagc

SEQ ID NO: 43566 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcgcgagaatgtggtggccatgggcgttagtgacaagagggacatcgagacgtcggaagagc

SEQ ID NO: 43567 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcgcaatgtggtggccatgggcgttagtgacaagagggacatcgagacgtcggaagagc

SEQ ID NO: 43568 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcgcgtggtggccatgggcgttagtgacaagagggacatcgagacgtcggaagagc

SEQ ID NO: 43569 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcgcgtggccatgggcgttagtgacaagagggacatcgagacgtcggaagagc

SEQ ID NO: 43570 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcgcgccatgggcgttagtgacaagagggacatcgagacgtcggaagagc

SEQ ID NO: 43571 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccgcatgggcgttagtgacaagagggacatcgagacgtcggaagagc

SEQ ID NO: 43572 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcgcggcgttagtgacaagagggacatcgagacgtcggaagagc

SEQ ID NO: 43573 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccgcgttagtgacaagagggacatcgagacgtcggaagagc

SEQ ID NO: 43574 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcgcagtgacaagagggacatcgagacgtcggaagagc

SEQ ID NO: 43575 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcgcgacaagagggacatcgagacgtcggaagagc

SEQ ID NO: 43576 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccgcaagagggacatcgagacgtcggaagagc

SEQ ID NO: 43577 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcgcagggacatcgagacgtcggaagagc

SEQ ID NO: 43578 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggcgcgacatcgagacgtcggaagagc

SEQ ID NO: 43579 - RNA, 299 nt, synthetic construct
  source 1..299: mol_type = other RNA
cgctcttccgcgtctcatgtacgtcccgggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43580 - RNA, 299 nt, synthetic construct
  source 1..299: mol_type = other RNA
cgctcttccgcgtctcatgtacgtcgggccggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43581 - RNA, 299 nt, synthetic construct
  source 1..299: mol_type = other RNA
cgctcttccgcgtctcatgtacgtcggggacccggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43582 - RNA, 299 nt, synthetic construct
  source 1..299: mol_type = other RNA
cgctcttccgcgtctcatgtacgtcggggacgtcccgcgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43583 - RNA, 299 nt, synthetic construct
  source 1..299: mol_type = other RNA
cgctcttccgcgtctcatgtacgtcggggacgtccgcccgagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43584 - RNA, 299 nt, synthetic construct
  source 1..299: mol_type = other RNA
cgctcttccgcgtctcatgtacgtcggggacgtccgcagcccggtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43585 - RNA, 299 nt, synthetic construct
  source 1..299: mol_type = other RNA
cgctcttccgcgtctcatgtacgtcggggacgtccgcagcgtcccgacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43586 - RNA, 299 nt, synthetic construct
  source 1..299: mol_type = other RNA
cgctcttccgcgtctcatgtacgtcggggacgtccgcagcgtcacaccgcagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43587 - RNA, 299 nt, synthetic construct
  source 1..299: mol_type = other RNA
cgctcttccgcgtctcatgtacgtcggggacgtccgcagcgtcacacagccgaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43588 - RNA, 299 nt, synthetic construct
  source 1..299: mol_type = other RNA
cgctcttccgcgtctcatgtacgtcggggacgtccgcagcgtcacacagaagccgcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43589 - RNA, 299 nt, synthetic construct
  source 1..299: mol_type = other RNA
cgctcttccgcgtctcatgtacgtcggggacgtccgcagcgtcacacagaagcatccgatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43590 - RNA, 299 nt, synthetic construct
  source 1..299: mol_type = other RNA
cgctcttccgcgtctcatgtacgtcggggacgtccgcagcgtcacacagaagcatatcccgcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43591 - RNA, 299 nt, synthetic construct
  source 1..299: mol_type = other RNA
cgctcttccgcgtctcatgtacgtcggggacgtccgcagcgtcacacagaagcatatccagccggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43592 - RNA, 299 nt, synthetic construct
  source 1..299: mol_type = other RNA
cgctcttccgcgtctcatgtacgtcggggacgtccgcagcgtcacacagaagcatatccaggagccgtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43593 - RNA, 299 nt, synthetic construct
  source 1..299: mol_type = other RNA
cgctcttccgcgtctcatgtacgtcggggacgtccgcagcgtcacacagaagcatatccaggagtggccgggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43594 - RNA, 299 nt, synthetic construct
  source 1..299: mol_type = other RNA
cgctcttccgcgtctcatgtacgtcggggacgtccgcagcgtcacacagaagcatatccaggagtggggcccgccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43595 - RNA, 299 nt, synthetic construct
  source 1..299: mol_type = other RNA
cgctcttccgcgtctcatgtacgtcggggacgtccgcagcgtcacacagaagcatatccaggagtggggcccaccgttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43596 - RNA, 299 nt, synthetic construct
  source 1..299: mol_type = other RNA
cgctcttccgcgtctcatgtacgtcggggacgtccgcagcgtcacacagaagcatatccaggagtggggcccattcccggacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43597 - RNA, 299 nt, synthetic construct
  source 1..299: mol_type = other RNA
cgctcttccgcgtctcatgtacgtcggggacgtccgcagcgtcacacagaagcatatccaggagtggggcccattcgacccgctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43598 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgccggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43599 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgccgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43600 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattccgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43601 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaccgggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43602 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcccgagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43603 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccgccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43604 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccccgtgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43605 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcccgaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43606 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacccggacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43607 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacccgctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43608 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcccgtccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43609 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccccgattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43610 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattccggtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43611 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcccgaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43612 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccgcctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43613 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctccggcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43614 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccccgcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43615 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcccgaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43616 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagccgggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43617 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggaccgctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43618 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttccgtatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43619 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatccggagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43620 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagccgggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43621 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtccgactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43622 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactccgggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43623 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcccgcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43624 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcccgctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43625 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcccgttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43626 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcccgtttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43627 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttccggagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43628 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagccgttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43629 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcccgtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43630 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacccgcgcctcctgcatgatgcgcggcccaaggagggagatgatcgccccttcttctggctctttgagaatgtggtggccatgggcgttagtgacaagagggacatcgagacgtcggaagagc

SEQ ID NO: 43631 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcccgctcctgcatgatgcgcggcccaaggagggagatgatcgccccttcttctggctctttgagaatgtggtggccatgggcgttagtgacaagagggacatcgagacgtcggaagagc

SEQ ID NO: 43632 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcccgctgcatgatgcgcggcccaaggagggagatgatcgccccttcttctggctctttgagaatgtggtggccatgggcgttagtgacaagagggacatcgagacgtcggaagagc

SEQ ID NO: 43633 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgccgcatgatgcgcggcccaaggagggagatgatcgccccttcttctggctctttgagaatgtggtggccatgggcgttagtgacaagagggacatcgagacgtcggaagagc

SEQ ID NO: 43634 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatccggatgcgcggcccaaggagggagatgatcgccccttcttctggctctttgagaatgtggtggccatgggcgttagtgacaagagggacatcgagacgtcggaagagc

SEQ ID NO: 43635 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatccggcgcggcccaaggagggagatgatcgccccttcttctggctctttgagaatgtggtggccatgggcgttagtgacaagagggacatcgagacgtcggaagagc

SEQ ID NO: 43636 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgccgcggcccaaggagggagatgatcgccccttcttctggctctttgagaatgtggtggccatgggcgttagtgacaagagggacatcgagacgtcggaagagc

SEQ ID NO: 43637 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccgcccaaggagggagatgatcgccccttcttctggctctttgagaatgtggtggccatgggcgttagtgacaagagggacatcgagacgtcggaagagc

SEQ ID NO: 43638 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccccgaaggagggagatgatcgccccttcttctggctctttgagaatgtggtggccatgggcgttagtgacaagagggacatcgagacgtcggaagagc

SEQ ID NO: 43639 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagccggagggagatgatcgccccttcttctggctctttgagaatgtggtggccatgggcgttagtgacaagagggacatcgagacgtcggaagagc

SEQ ID NO: 43640 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagccgggagatgatcgccccttcttctggctctttgagaatgtggtggccatgggcgttagtgacaagagggacatcgagacgtcggaagagc

SEQ ID NO: 43641 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggaccggatgatcgccccttcttctggctctttgagaatgtggtggccatgggcgttagtgacaagagggacatcgagacgtcggaagagc

SEQ ID NO: 43642 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatccggatcgccccttcttctggctctttgagaatgtggtggccatgggcgttagtgacaagagggacatcgagacgtcggaagagc

SEQ ID NO: 43643 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatccgcgccccttcttctggctctttgagaatgtggtggccatgggcgttagtgacaagagggacatcgagacgtcggaagagc

SEQ ID NO: 43644 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccgcccttcttctggctctttgagaatgtggtggccatgggcgttagtgacaagagggacatcgagacgtcggaagagc

SEQ ID NO: 43645 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccccgttcttctggctctttgagaatgtggtggccatgggcgttagtgacaagagggacatcgagacgtcggaagagc

SEQ ID NO: 43646 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcccgttctggctctttgagaatgtggtggccatgggcgttagtgacaagagggacatcgagacgtcggaagagc

SEQ ID NO: 43647 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcccgtggctctttgagaatgtggtggccatgggcgttagtgacaagagggacatcgagacgtcggaagagc

SEQ ID NO: 43648 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggccgctctttgagaatgtggtggccatgggcgttagtgacaagagggacatcgagacgtcggaagagc

SEQ ID NO: 43649 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcccgtttgagaatgtggtggccatgggcgttagtgacaagagggacatcgagacgtcggaagagc

SEQ ID NO: 43650 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttccggagaatgtggtggccatgggcgttagtgacaagagggacatcgagacgtcggaagagc

SEQ ID NO: 43651 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagccgaatgtggtggccatgggcgttagtgacaagagggacatcgagacgtcggaagagc

SEQ ID NO: 43652 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatccggtggtggccatgggcgttagtgacaagagggacatcgagacgtcggaagagc

SEQ ID NO: 43653 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgccggtggccatgggcgttagtgacaagagggacatcgagacgtcggaagagc

SEQ ID NO: 43654 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgccggccatgggcgttagtgacaagagggacatcgagacgtcggaagagc

SEQ ID NO: 43655 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccccgatgggcgttagtgacaagagggacatcgagacgtcggaagagc

SEQ ID NO: 43656 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgccgggcgttagtgacaagagggacatcgagacgtcggaagagc

SEQ ID NO: 43657 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcccggttagtgacaagagggacatcgagacgtcggaagagc

SEQ ID NO: 43658 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttccgagtgacaagagggacatcgagacgtcggaagagc

SEQ ID NO: 43659 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtccggacaagagggacatcgagacgtcggaagagc

SEQ ID NO: 43660 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacccgaagagggacatcgagacgtcggaagagc

SEQ ID NO: 43661 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagccgagggacatcgagacgtcggaagagc

SEQ ID NO: 43662 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggccggacatcgagacgtcggaagagc

SEQ ID NO: 43663 - RNA, 299 nt, synthetic construct
  source 1..299: mol_type = other RNA
cgctcttccgcgtctcatgtacgtccccggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43664 - RNA, 299 nt, synthetic construct
  source 1..299: mol_type = other RNA
cgctcttccgcgtctcatgtacgtcgggcccgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43665 - RNA, 299 nt, synthetic construct
  source 1..299: mol_type = other RNA
cgctcttccgcgtctcatgtacgtcggggaccccgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43666 - RNA, 299 nt, synthetic construct
  source 1..299: mol_type = other RNA
cgctcttccgcgtctcatgtacgtcggggacgtcccccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43667 - RNA, 299 nt, synthetic construct
  source 1..299: mol_type = other RNA
cgctcttccgcgtctcatgtacgtcggggacgtccgccccagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43668 - RNA, 299 nt, synthetic construct
  source 1..299: mol_type = other RNA
cgctcttccgcgtctcatgtacgtcggggacgtccgcagccccgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43669 - RNA, 299 nt, synthetic construct
  source 1..299: mol_type = other RNA
cgctcttccgcgtctcatgtacgtcggggacgtccgcagcgtccccacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43670 - RNA, 299 nt, synthetic construct
  source 1..299: mol_type = other RNA
cgctcttccgcgtctcatgtacgtcggggacgtccgcagcgtcacaccccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43671 - RNA, 299 nt, synthetic construct
  source 1..299: mol_type = other RNA
cgctcttccgcgtctcatgtacgtcggggacgtccgcagcgtcacacagcccaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43672 - RNA, 299 nt, synthetic construct
  source 1..299: mol_type = other RNA
cgctcttccgcgtctcatgtacgtcggggacgtccgcagcgtcacacagaagccccatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43673 - RNA, 299 nt, synthetic construct
  source 1..299: mol_type = other RNA
cgctcttccgcgtctcatgtacgtcggggacgtccgcagcgtcacacagaagcatcccatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43674 - RNA, 299 nt, synthetic construct
  source 1..299: mol_type = other RNA
cgctcttccgcgtctcatgtacgtcggggacgtccgcagcgtcacacagaagcatatcccccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43675 - RNA, 299 nt, synthetic construct
  source 1..299: mol_type = other RNA
cgctcttccgcgtctcatgtacgtcggggacgtccgcagcgtcacacagaagcatatccagcccgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43676 - RNA, 299 nt, synthetic construct
  source 1..299: mol_type = other RNA
cgctcttccgcgtctcatgtacgtcggggacgtccgcagcgtcacacagaagcatatccaggagccctggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43677 - RNA, 299 nt, synthetic construct
  source 1..299: mol_type = other RNA
cgctcttccgcgtctcatgtacgtcggggacgtccgcagcgtcacacagaagcatatccaggagtggcccggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43678 - RNA, 299 nt, synthetic construct
  source 1..299: mol_type = other RNA
cgctcttccgcgtctcatgtacgtcggggacgtccgcagcgtcacacagaagcatatccaggagtggggccccccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43679 - RNA, 299 nt, synthetic construct
  source 1..299: mol_type = other RNA
cgctcttccgcgtctcatgtacgtcggggacgtccgcagcgtcacacagaagcatatccaggagtggggcccacccttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43680 - RNA, 299 nt, synthetic construct
  source 1..299: mol_type = other RNA
cgctcttccgcgtctcatgtacgtcggggacgtccgcagcgtcacacagaagcatatccaggagtggggcccattccccgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43681 - RNA, 299 nt, synthetic construct
  source 1..299: mol_type = other RNA
cgctcttccgcgtctcatgtacgtcggggacgtccgcagcgtcacacagaagcatatccaggagtggggcccattcgaccccctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43682 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctgcccgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43683 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgcccattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43684 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattcccggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43685 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggacccggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43686 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggccccagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43687 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtcccccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43688 - RNA, 299 nt, synthetic construct; identical to SEQ ID NO: 43687
  source 1..299: mol_type = other RNA

SEQ ID NO: 43689 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgccccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43690 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaaccccgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43691 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgaccccctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43692 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctcccctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43693 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctcccccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43694 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattcccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43695 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccccaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43696 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacccccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43697 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcccgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43698 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccccccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43699 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgccccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43700 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagcccggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43701 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacccctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43702 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttccctatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43703 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatcccgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43704 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagcccggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43705 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtcccactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43706 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcccggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43707 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcccccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43708 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgccccctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43709 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctccccttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43710 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcccctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43711 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttcccgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43712 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagcccttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43713 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttcccctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43714 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacccccgcctcctgcatgatgcgcggcccaaggagggagatgatcgccccttcttctggctctttgagaatgtggtggccatgggcgttagtgacaagagggacatcgagacgtcggaagagc

SEQ ID NO: 43715 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgccccctcctgcatgatgcgcggcccaaggagggagatgatcgccccttcttctggctctttgagaatgtggtggccatgggcgttagtgacaagagggacatcgagacgtcggaagagc

SEQ ID NO: 43716 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccccctgcatgatgcgcggcccaaggagggagatgatcgccccttcttctggctctttgagaatgtggtggccatgggcgttagtgacaagagggacatcgagacgtcggaagagc

SEQ ID NO: 43717 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgccccatgatgcgcggcccaaggagggagatgatcgccccttcttctggctctttgagaatgtggtggccatgggcgttagtgacaagagggacatcgagacgtcggaagagc

SEQ ID NO: 43718 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatcccgatgcgcggcccaaggagggagatgatcgccccttcttctggctctttgagaatgtggtggccatgggcgttagtgacaagagggacatcgagacgtcggaagagc

SEQ ID NO: 43719 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcccgcgcggcccaaggagggagatgatcgccccttcttctggctctttgagaatgtggtggccatgggcgttagtgacaagagggacatcgagacgtcggaagagc

SEQ ID NO: 43720 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgccccggcccaaggagggagatgatcgccccttcttctggctctttgagaatgtggtggccatgggcgttagtgacaagagggacatcgagacgtcggaagagc

SEQ ID NO: 43721 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggccccccaaggagggagatgatcgccccttcttctggctctttgagaatgtggtggccatgggcgttagtgacaagagggacatcgagacgtcggaagagc

SEQ ID NO: 43722 - RNA, 299 nt, synthetic construct; identical to SEQ ID NO: 43721
  source 1..299: mol_type = other RNA

SEQ ID NO: 43723 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagcccgagggagatgatcgccccttcttctggctctttgagaatgtggtggccatgggcgttagtgacaagagggacatcgagacgtcggaagagc

SEQ ID NO: 43724 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagcccggagatgatcgccccttcttctggctctttgagaatgtggtggccatgggcgttagtgacaagagggacatcgagacgtcggaagagc

SEQ ID NO: 43725 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggacccgatgatcgccccttcttctggctctttgagaatgtggtggccatgggcgttagtgacaagagggacatcgagacgtcggaagagc

SEQ ID NO: 43726 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcccgatcgccccttcttctggctctttgagaatgtggtggccatgggcgttagtgacaagagggacatcgagacgtcggaagagc

SEQ ID NO: 43727 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatccccgccccttcttctggctctttgagaatgtggtggccatgggcgttagtgacaagagggacatcgagacgtcggaagagc

SEQ ID NO: 43728 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcccccccttcttctggctctttgagaatgtggtggccatgggcgttagtgacaagagggacatcgagacgtcggaagagc

SEQ ID NO: 43729 - RNA, 299 nt, synthetic construct; identical to SEQ ID NO: 43728
  source 1..299: mol_type = other RNA

SEQ ID NO: 43730 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttccccttctggctctttgagaatgtggtggccatgggcgttagtgacaagagggacatcgagacgtcggaagagc

SEQ ID NO: 43731 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcccctggctctttgagaatgtggtggccatgggcgttagtgacaagagggacatcgagacgtcggaagagc

SEQ ID NO: 43732 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggcccctctttgagaatgtggtggccatgggcgttagtgacaagagggacatcgagacgtcggaagagc

SEQ ID NO: 43733 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcccctttgagaatgtggtggccatgggcgttagtgacaagagggacatcgagacgtcggaagagc

SEQ ID NO: 43734 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttcccgagaatgtggtggccatgggcgttagtgacaagagggacatcgagacgtcggaagagc

SEQ ID NO: 43735 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagcccaatgtggtggccatgggcgttagtgacaagagggacatcgagacgtcggaagagc

SEQ ID NO: 43736 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatcccgtggtggccatgggcgttagtgacaagagggacatcgagacgtcggaagagc

SEQ ID NO: 43737 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtgcccgtggccatgggcgttagtgacaagagggacatcgagacgtcggaagagc

SEQ ID NO: 43738 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgcccgccatgggcgttagtgacaagagggacatcgagacgtcggaagagc

SEQ ID NO: 43739 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggcccccatgggcgttagtgacaagagggacatcgagacgtcggaagagc

SEQ ID NO: 43740 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgcccggcgttagtgacaagagggacatcgagacgtcggaagagc

SEQ ID NO: 43741 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggccccgttagtgacaagagggacatcgagacgtcggaagagc

SEQ ID NO: 43742 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttcccagtgacaagagggacatcgagacgtcggaagagc

SEQ ID NO: 43743 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtcccgacaagagggacatcgagacgtcggaagagc

SEQ ID NO: 43744 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgaccccaagagggacatcgagacgtcggaagagc

SEQ ID NO: 43745 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagcccagggacatcgagacgtcggaagagc

SEQ ID NO: 43746 - RNA, 299 nt, synthetic construct
  source 1..299: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagaggcccgacatcgagacgtcggaagagc

SEQ ID NO: 43747 - RNA, 293 nt, synthetic construct
  source 1..293: mol_type = other RNA
cgctcttccgcgtctcatgtacggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43748 - RNA, 293 nt, synthetic construct
  source 1..293: mol_type = other RNA
cgctcttccgcgtctcatgtacgtcgacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43749 - RNA, 293 nt, synthetic construct
  source 1..293: mol_type = other RNA
cgctcttccgcgtctcatgtacgtcggggtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43750 - RNA, 293 nt, synthetic construct
  source 1..293: mol_type = other RNA
cgctcttccgcgtctcatgtacgtcggggaccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43751 - RNA, 293 nt, synthetic construct
  source 1..293: mol_type = other RNA
cgctcttccgcgtctcatgtacgtcggggacgtcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43752 - RNA, 293 nt, synthetic construct
  source 1..293: mol_type = other RNA
cgctcttccgcgtctcatgtacgtcggggacgtccgcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43753 - RNA, 293 nt, synthetic construct
  source 1..293: mol_type = other RNA
cgctcttccgcgtctcatgtacgtcggggacgtccgcagcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43754 - RNA, 293 nt, synthetic construct
  source 1..293: mol_type = other RNA
cgctcttccgcgtctcatgtacgtcggggacgtccgcagcgtccagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43755 - RNA, 293 nt, synthetic construct
  source 1..293: mol_type = other RNA
cgctcttccgcgtctcatgtacgtcggggacgtccgcagcgtcacaaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43756 - RNA, 293 nt, synthetic construct
  source 1..293: mol_type = other RNA
cgctcttccgcgtctcatgtacgtcggggacgtccgcagcgtcacacagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43757 - RNA, 293 nt, synthetic construct
  source 1..293: mol_type = other RNA
cgctcttccgcgtctcatgtacgtcggggacgtccgcagcgtcacacagaagatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43758 - RNA, 293 nt, synthetic construct
  source 1..293: mol_type = other RNA
cgctcttccgcgtctcatgtacgtcggggacgtccgcagcgtcacacagaagcatcaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43759 - RNA, 293 nt, synthetic construct
  source 1..293: mol_type = other RNA
cgctcttccgcgtctcatgtacgtcggggacgtccgcagcgtcacacagaagcatatcgagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43760 - RNA, 293 nt, synthetic construct
  source 1..293: mol_type = other RNA
cgctcttccgcgtctcatgtacgtcggggacgtccgcagcgtcacacagaagcatatccagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43761 - RNA, 293 nt, synthetic construct
  source 1..293: mol_type = other RNA
cgctcttccgcgtctcatgtacgtcggggacgtccgcagcgtcacacagaagcatatccaggagggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43762 - RNA, 293 nt, synthetic construct
  source 1..293: mol_type = other RNA
cgctcttccgcgtctcatgtacgtcggggacgtccgcagcgtcacacagaagcatatccaggagtggccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43763 - RNA, 293 nt, synthetic construct
  source 1..293: mol_type = other RNA
cgctcttccgcgtctcatgtacgtcggggacgtccgcagcgtcacacagaagcatatccaggagtggggcttcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43764 - RNA, 293 nt, synthetic construct
  source 1..293: mol_type = other RNA
cgctcttccgcgtctcatgtacgtcggggacgtccgcagcgtcacacagaagcatatccaggagtggggcccagacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43765 - RNA, 293 nt, synthetic construct
  source 1..293: mol_type = other RNA
cgctcttccgcgtctcatgtacgtcggggacgtccgcagcgtcacacagaagcatatccaggagtggggcccattcctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43766 - RNA, 293 nt, synthetic construct
  source 1..293: mol_type = other RNA
cgctcttccgcgtctcatgtacgtcggggacgtccgcagcgtcacacagaagcatatccaggagtggggcccattcgacgtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43767 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43768 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43769 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43770 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43771 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43772 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagttgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43773 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtcccaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43774 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43775 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43776 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgactccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43777 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctcattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43778 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43779 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43780 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43781 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaacgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43782 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctcgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43783 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgccaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43784 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcggactttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43785 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagctttatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43786 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggatatgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43787 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggacttgagggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43788 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatggtactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43789 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagactggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43790 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtggccgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43791 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactcgcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43792 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggcctcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43793 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcttctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43794 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctctttgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43795 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttcgagttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43796 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttttctaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43797 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagtaccgcctcctgcatgatgcgcggcccaaggagggagatgatcgccccttcttctggctctttgagaatgtggtggccatgggcgttagtgacaagagggacatcgagacgtcggaagagc

SEQ ID NO: 43798 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttccgcctcctgcatgatgcgcggcccaaggagggagatgatcgccccttcttctggctctttgagaatgtggtggccatgggcgttagtgacaagagggacatcgagacgtcggaagagc

SEQ ID NO: 43799 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctacctcctgcatgatgcgcggcccaaggagggagatgatcgccccttcttctggctctttgagaatgtggtggccatgggcgttagtgacaagagggacatcgagacgtcggaagagc

SEQ ID NO: 43800 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctgcatgatgcgcggcccaaggagggagatgatcgccccttcttctggctctttgagaatgtggtggccatgggcgttagtgacaagagggacatcgagacgtcggaagagc

SEQ ID NO: 43801 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctccatgatgcgcggcccaaggagggagatgatcgccccttcttctggctctttgagaatgtggtggccatgggcgttagtgacaagagggacatcgagacgtcggaagagc

SEQ ID NO: 43802 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctggatgcgcggcccaaggagggagatgatcgccccttcttctggctctttgagaatgtggtggccatgggcgttagtgacaagagggacatcgagacgtcggaagagc

SEQ ID NO: 43803 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgcgcggcccaaggagggagatgatcgccccttcttctggctctttgagaatgtggtggccatgggcgttagtgacaagagggacatcgagacgtcggaagagc

SEQ ID NO: 43804 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatcggcccaaggagggagatgatcgccccttcttctggctctttgagaatgtggtggccatgggcgttagtgacaagagggacatcgagacgtcggaagagc

SEQ ID NO: 43805 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcccaaggagggagatgatcgccccttcttctggctctttgagaatgtggtggccatgggcgttagtgacaagagggacatcgagacgtcggaagagc

SEQ ID NO: 43806 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggaaggagggagatgatcgccccttcttctggctctttgagaatgtggtggccatgggcgttagtgacaagagggacatcgagacgtcggaagagc

SEQ ID NO: 43807 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccgagggagatgatcgccccttcttctggctctttgagaatgtggtggccatgggcgttagtgacaagagggacatcgagacgtcggaagagc

SEQ ID NO: 43808 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaagggagatgatcgccccttcttctggctctttgagaatgtggtggccatgggcgttagtgacaagagggacatcgagacgtcggaagagc

SEQ ID NO: 43809 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggaggatgatcgccccttcttctggctctttgagaatgtggtggccatgggcgttagtgacaagagggacatcgagacgtcggaagagc

SEQ ID NO: 43810 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatcgccccttcttctggctctttgagaatgtggtggccatgggcgttagtgacaagagggacatcgagacgtcggaagagc

SEQ ID NO: 43811 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcccttcttctggctctttgagaatgtggtggccatgggcgttagtgacaagagggacatcgagacgtcggaagagc

SEQ ID NO: 43812 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgcttcttctggctctttgagaatgtggtggccatgggcgttagtgacaagagggacatcgagacgtcggaagagc

SEQ ID NO: 43813 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttctggctctttgagaatgtggtggccatgggcgttagtgacaagagggacatcgagacgtcggaagagc

SEQ ID NO: 43814 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttcctctttgagaatgtggtggccatgggcgttagtgacaagagggacatcgagacgtcggaagagc

SEQ ID NO: 43815 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggtttgagaatgtggtggccatgggcgttagtgacaagagggacatcgagacgtcggaagagc

SEQ ID NO: 43816 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctcgagaatgtggtggccatgggcgttagtgacaagagggacatcgagacgtcggaagagc

SEQ ID NO: 43817 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttaatgtggtggccatgggcgttagtgacaagagggacatcgagacgtcggaagagc

SEQ ID NO: 43818 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgaggtggtggccatgggcgttagtgacaagagggacatcgagacgtcggaagagc

SEQ ID NO: 43819 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggccatgggcgttagtgacaagagggacatcgagacgtcggaagagc

SEQ ID NO: 43820 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtgatgggcgttagtgacaagagggacatcgagacgtcggaagagc

SEQ ID NO: 43821 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccggcgttagtgacaagagggacatcgagacgtcggaagagc

SEQ ID NO: 43822 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatggttagtgacaagagggacatcgagacgtcggaagagc

SEQ ID NO: 43823 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcagtgacaagagggacatcgagacgtcggaagagc

SEQ ID NO: 43824 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttgacaagagggacatcgagacgtcggaagagc

SEQ ID NO: 43825 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtaagagggacatcgagacgtcggaagagc

SEQ ID NO: 43826 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacagggacatcgagacgtcggaagagc

SEQ ID NO: 43827 - RNA, 293 nt, synthetic construct
  source 1..293: mol_type = other RNA
cgctcttccgcgtctcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaaggacatcgagacgtcggaagagc

SEQ ID NO: 43828 - RNA, 296 nt, synthetic construct; identical to SEQ ID NO: 38380
  source 1..296: mol_type = other RNA

SEQ ID NO: 43829 - RNA, 296 nt, synthetic construct
  source 1..296: mol_type = other RNA
cgctcttccgcgtctcaagaggaagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43830 - RNA, 296 nt, synthetic construct
  source 1..296: mol_type = other RNA
cgctcttccgcgtctcaagagggacaagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43831 - RNA, 296 nt, synthetic construct
  source 1..296: mol_type = other RNA
cgctcttccgcgtctcaagagggacatcaagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43832 - RNA, 296 nt, synthetic construct
  source 1..296: mol_type = other RNA
cgctcttccgcgtctcaagagggacatctcgaagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43833 - RNA, 296 nt, synthetic construct
  source 1..296: mol_type = other RNA
cgctcttccgcgtctcaagagggacatctcgcgaaagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43834 - RNA, 296 nt, synthetic construct
  source 1..296: mol_type = other RNA
cgctcttccgcgtctcaagagggacatctcgcgatttaaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43835 - RNA, 296 nt, synthetic construct
  source 1..296: mol_type = other RNA
cgctcttccgcgtctcaagagggacatctcgcgatttcttaagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43836 - RNA, 296 nt, synthetic construct
  source 1..296: mol_type = other RNA
cgctcttccgcgtctcaagagggacatctcgcgatttcttgagaagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43837 - RNA, 296 nt, synthetic construct
  source 1..296: mol_type = other RNA
cgctcttccgcgtctcaagagggacatctcgcgatttcttgagtctaagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43838 - RNA, 296 nt, synthetic construct
  source 1..296: mol_type = other RNA
cgctcttccgcgtctcaagagggacatctcgcgatttcttgagtctaacaaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43839 - RNA, 296 nt, synthetic construct
  source 1..296: mol_type = other RNA
cgctcttccgcgtctcaagagggacatctcgcgatttcttgagtctaaccccaagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43840 - RNA, 296 nt, synthetic construct
  source 1..296: mol_type = other RNA
cgctcttccgcgtctcaagagggacatctcgcgatttcttgagtctaaccccgtgaagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43841 - RNA, 296 nt, synthetic construct
  source 1..296: mol_type = other RNA
cgctcttccgcgtctcaagagggacatctcgcgatttcttgagtctaaccccgtgatgaaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43842 - RNA, 296 nt, synthetic construct
  source 1..296: mol_type = other RNA
cgctcttccgcgtctcaagagggacatctcgcgatttcttgagtctaaccccgtgatgattaaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43843 - RNA, 296 nt, synthetic construct
  source 1..296: mol_type = other RNA
cgctcttccgcgtctcaagagggacatctcgcgatttcttgagtctaaccccgtgatgattgacaagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43844 - RNA, 296 nt, synthetic construct
  source 1..296: mol_type = other RNA
cgctcttccgcgtctcaagagggacatctcgcgatttcttgagtctaaccccgtgatgattgacgccaaggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43845 - RNA, 296 nt, synthetic construct
  source 1..296: mol_type = other RNA
cgctcttccgcgtctcaagagggacatctcgcgatttcttgagtctaaccccgtgatgattgacgccaaaaaggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43846 - RNA, 296 nt, synthetic construct
  source 1..296: mol_type = other RNA
cgctcttccgcgtctcaagagggacatctcgcgatttcttgagtctaaccccgtgatgattgacgccaaagaaaagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43847 - RNA, 296 nt, synthetic construct
  source 1..296: mol_type = other RNA
cgctcttccgcgtctcaagagggacatctcgcgatttcttgagtctaaccccgtgatgattgacgccaaagaagtgaaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43848 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctaaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43849 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctaagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43850 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaaagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43851 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43852 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggaagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43853 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccaagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43854 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtaagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43855 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacaagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43856 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcaagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43857 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggaagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43858 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43859 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacaagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43860 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttaagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43861 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43862 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43863 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43864 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43865 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggaagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43866 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctaaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43867 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgaagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43868 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaaagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43869 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccaaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43870 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43871 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43872 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43873 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43874 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagaaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43875 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgaagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43876 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagaagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43877 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgaaggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43878 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaaagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43879 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagaagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43880 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtaaggagcacggcagaatagccaagttcagcaaagtgaggaccattaccaccaggtcaaactctataaagcagggcaaagaccagcatttccccgtcttcatgaacgagacgtcggaagagc

SEQ ID NO: 43881 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgaagcacggcagaatagccaagttcagcaaagtgaggaccattaccaccaggtcaaactctataaagcagggcaaagaccagcatttccccgtcttcatgaacgagacgtcggaagagc

SEQ ID NO: 43882 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagaagggcagaatagccaagttcagcaaagtgaggaccattaccaccaggtcaaactctataaagcagggcaaagaccagcatttccccgtcttcatgaacgagacgtcggaagagc

SEQ ID NO: 43883 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaagagaatagccaagttcagcaaagtgaggaccattaccaccaggtcaaactctataaagcagggcaaagaccagcatttccccgtcttcatgaacgagacgtcggaagagc

SEQ ID NO: 43884 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaagatagccaagttcagcaaagtgaggaccattaccaccaggtcaaactctataaagcagggcaaagaccagcatttccccgtcttcatgaacgagacgtcggaagagc

SEQ ID NO: 43885 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaaaggccaagttcagcaaagtgaggaccattaccaccaggtcaaactctataaagcagggcaaagaccagcatttccccgtcttcatgaacgagacgtcggaagagc

SEQ ID NO: 43886 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaagaagttcagcaaagtgaggaccattaccaccaggtcaaactctataaagcagggcaaagaccagcatttccccgtcttcatgaacgagacgtcggaagagc

SEQ ID NO: 43887 - RNA, 296 nt, synthetic construct; identical to SEQ ID NO: 43873
  source 1..296: mol_type = other RNA

SEQ ID NO: 43888 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaagagcaaagtgaggaccattaccaccaggtcaaactctataaagcagggcaaagaccagcatttccccgtcttcatgaacgagacgtcggaagagc

SEQ ID NO: 43889 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaagaaagtgaggaccattaccaccaggtcaaactctataaagcagggcaaagaccagcatttccccgtcttcatgaacgagacgtcggaagagc

SEQ ID NO: 43890 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaggtgaggaccattaccaccaggtcaaactctataaagcagggcaaagaccagcatttccccgtcttcatgaacgagacgtcggaagagc

SEQ ID NO: 43891 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaagaggaccattaccaccaggtcaaactctataaagcagggcaaagaccagcatttccccgtcttcatgaacgagacgtcggaagagc

SEQ ID NO: 43892 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaagaccattaccaccaggtcaaactctataaagcagggcaaagaccagcatttccccgtcttcatgaacgagacgtcggaagagc

SEQ ID NO: 43893 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaagattaccaccaggtcaaactctataaagcagggcaaagaccagcatttccccgtcttcatgaacgagacgtcggaagagc

SEQ ID NO: 43894 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaagaccaccaggtcaaactctataaagcagggcaaagaccagcatttccccgtcttcatgaacgagacgtcggaagagc

SEQ ID NO: 43895 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaagaccaggtcaaactctataaagcagggcaaagaccagcatttccccgtcttcatgaacgagacgtcggaagagc

SEQ ID NO: 43896 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaagaggtcaaactctataaagcagggcaaagaccagcatttccccgtcttcatgaacgagacgtcggaagagc

SEQ ID NO: 43897 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaagtcaaactctataaagcagggcaaagaccagcatttccccgtcttcatgaacgagacgtcggaagagc

SEQ ID NO: 43898 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaagaactctataaagcagggcaaagaccagcatttccccgtcttcatgaacgagacgtcggaagagc

SEQ ID NO: 43899 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaagtctataaagcagggcaaagaccagcatttccccgtcttcatgaacgagacgtcggaagagc

SEQ ID NO: 43900 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacaagataaagcagggcaaagaccagcatttccccgtcttcatgaacgagacgtcggaagagc

SEQ ID NO: 43901 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaagaagcagggcaaagaccagcatttccccgtcttcatgaacgagacgtcggaagagc

SEQ ID NO: 43902 - RNA, 296 nt, synthetic construct; identical to SEQ ID NO: 43873
  source 1..296: mol_type = other RNA

SEQ ID NO: 43903 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagaagggcaaagaccagcatttccccgtcttcatgaacgagacgtcggaagagc

SEQ ID NO: 43904 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaagaaagaccagcatttccccgtcttcatgaacgagacgtcggaagagc

SEQ ID NO: 43905 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaggaccagcatttccccgtcttcatgaacgagacgtcggaagagc

SEQ ID NO: 43906 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaaagcagcatttccccgtcttcatgaacgagacgtcggaagagc

SEQ ID NO: 43907 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacaagcatttccccgtcttcatgaacgagacgtcggaagagc

SEQ ID NO: 43908 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagaagttccccgtcttcatgaacgagacgtcggaagagc

SEQ ID NO: 43909 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcataagcccgtcttcatgaacgagacgtcggaagagc

SEQ ID NO: 43910 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcaaggtcttcatgaacgagacgtcggaagagc

SEQ ID NO: 43911 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccaagttcatgaacgagacgtcggaagagc

SEQ ID NO: 43912 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaagatgaacgagacgtcggaagagc

SEQ ID NO: 43913 - RNA, 296 nt, synthetic construct
  source 1..296: mol_type = other RNA
cgctcttccgcgtctcaagaggaacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43914 - RNA, 296 nt, synthetic construct
  source 1..296: mol_type = other RNA
cgctcttccgcgtctcaagagggacaactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43915 - RNA, 296 nt, synthetic construct
  source 1..296: mol_type = other RNA
cgctcttccgcgtctcaagagggacatcaaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43916 - RNA, 296 nt, synthetic construct
  source 1..296: mol_type = other RNA
cgctcttccgcgtctcaagagggacatctcgaactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43917 - RNA, 296 nt, synthetic construct
  source 1..296: mol_type = other RNA
cgctcttccgcgtctcaagagggacatctcgcgaaaccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43918 - RNA, 296 nt, synthetic construct
  source 1..296: mol_type = other RNA
cgctcttccgcgtctcaagagggacatctcgcgatttaacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43919 - RNA, 296 nt, synthetic construct
  source 1..296: mol_type = other RNA
cgctcttccgcgtctcaagagggacatctcgcgatttcttaactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43920 - RNA, 296 nt, synthetic construct
  source 1..296: mol_type = other RNA
cgctcttccgcgtctcaagagggacatctcgcgatttcttgagaacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43921 - RNA, 296 nt, synthetic construct; identical to SEQ ID NO: 43873
  source 1..296: mol_type = other RNA

SEQ ID NO: 43922 - RNA, 296 nt, synthetic construct
  source 1..296: mol_type = other RNA
cgctcttccgcgtctcaagagggacatctcgcgatttcttgagtctaacaacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43923 - RNA, 296 nt, synthetic construct
  source 1..296: mol_type = other RNA
cgctcttccgcgtctcaagagggacatctcgcgatttcttgagtctaaccccaacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43924 - RNA, 296 nt, synthetic construct
  source 1..296: mol_type = other RNA
cgctcttccgcgtctcaagagggacatctcgcgatttcttgagtctaaccccgtgaacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43925 - RNA, 296 nt, synthetic construct
  source 1..296: mol_type = other RNA
cgctcttccgcgtctcaagagggacatctcgcgatttcttgagtctaaccccgtgatgaacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43926 - RNA, 296 nt, synthetic construct
  source 1..296: mol_type = other RNA
cgctcttccgcgtctcaagagggacatctcgcgatttcttgagtctaaccccgtgatgattaacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43927 - RNA, 296 nt, synthetic construct
  source 1..296: mol_type = other RNA
cgctcttccgcgtctcaagagggacatctcgcgatttcttgagtctaaccccgtgatgattgacaacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43928 - RNA, 296 nt, synthetic construct
  source 1..296: mol_type = other RNA
cgctcttccgcgtctcaagagggacatctcgcgatttcttgagtctaaccccgtgatgattgacgccaacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43929 - RNA, 296 nt, synthetic construct
  source 1..296: mol_type = other RNA
cgctcttccgcgtctcaagagggacatctcgcgatttcttgagtctaaccccgtgatgattgacgccaaaaacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43930 - RNA, 296 nt, synthetic construct
  source 1..296: mol_type = other RNA
cgctcttccgcgtctcaagagggacatctcgcgatttcttgagtctaaccccgtgatgattgacgccaaagaaaactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43931 - RNA, 296 nt, synthetic construct
  source 1..296: mol_type = other RNA
cgctcttccgcgtctcaagagggacatctcgcgatttcttgagtctaaccccgtgatgattgacgccaaagaagtgaacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43932 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctaacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43933 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctaaccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43934 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaaacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43935 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43936 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggaaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43937 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccaactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43938 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtaacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43939 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacaactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43940 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcaacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43941 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggaacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43942 - RNA, 296 nt, synthetic construct; identical to SEQ ID NO: 43873
  source 1..296: mol_type = other RNA

SEQ ID NO: 43943 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacaaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43944 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttaacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43945 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43946 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43947 - RNA, 296 nt, synthetic construct; identical to SEQ ID NO: 43873
  source 1..296: mol_type = other RNA

SEQ ID NO: 43948 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43949 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggaacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43950 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctaacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43951 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgaactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43952 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaaacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43953 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccaacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43954 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43955 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43956 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43957 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43958 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagaacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43959 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgaacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43960 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagaaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43961 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgaacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43962 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaaactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43963 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagaacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43964 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtaacgagcacggcagaatagccaagttcagcaaagtgaggaccattaccaccaggtcaaactctataaagcagggcaaagaccagcatttccccgtcttcatgaacgagacgtcggaagagc

SEQ ID NO: 43965 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgaaccacggcagaatagccaagttcagcaaagtgaggaccattaccaccaggtcaaactctataaagcagggcaaagaccagcatttccccgtcttcatgaacgagacgtcggaagagc

SEQ ID NO: 43966 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagaacggcagaatagccaagttcagcaaagtgaggaccattaccaccaggtcaaactctataaagcagggcaaagaccagcatttccccgtcttcatgaacgagacgtcggaagagc

SEQ ID NO: 43967 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaacagaatagccaagttcagcaaagtgaggaccattaccaccaggtcaaactctataaagcagggcaaagaccagcatttccccgtcttcatgaacgagacgtcggaagagc

SEQ ID NO: 43968 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaacatagccaagttcagcaaagtgaggaccattaccaccaggtcaaactctataaagcagggcaaagaccagcatttccccgtcttcatgaacgagacgtcggaagagc

SEQ ID NO: 43969 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaaacgccaagttcagcaaagtgaggaccattaccaccaggtcaaactctataaagcagggcaaagaccagcatttccccgtcttcatgaacgagacgtcggaagagc

SEQ ID NO: 43970 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaacaagttcagcaaagtgaggaccattaccaccaggtcaaactctataaagcagggcaaagaccagcatttccccgtcttcatgaacgagacgtcggaagagc

SEQ ID NO: 43971 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaacttcagcaaagtgaggaccattaccaccaggtcaaactctataaagcagggcaaagaccagcatttccccgtcttcatgaacgagacgtcggaagagc

SEQ ID NO: 43972 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaacagcaaagtgaggaccattaccaccaggtcaaactctataaagcagggcaaagaccagcatttccccgtcttcatgaacgagacgtcggaagagc

SEQ ID NO: 43973 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaacaaagtgaggaccattaccaccaggtcaaactctataaagcagggcaaagaccagcatttccccgtcttcatgaacgagacgtcggaagagc

SEQ ID NO: 43974 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaacgtgaggaccattaccaccaggtcaaactctataaagcagggcaaagaccagcatttccccgtcttcatgaacgagacgtcggaagagc

SEQ ID NO: 43975 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaacaggaccattaccaccaggtcaaactctataaagcagggcaaagaccagcatttccccgtcttcatgaacgagacgtcggaagagc

SEQ ID NO: 43976 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaacaccattaccaccaggtcaaactctataaagcagggcaaagaccagcatttccccgtcttcatgaacgagacgtcggaagagc

SEQ ID NO: 43977 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaacattaccaccaggtcaaactctataaagcagggcaaagaccagcatttccccgtcttcatgaacgagacgtcggaagagc

SEQ ID NO: 43978 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaacaccaccaggtcaaactctataaagcagggcaaagaccagcatttccccgtcttcatgaacgagacgtcggaagagc

SEQ ID NO: 43979 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaacaccaggtcaaactctataaagcagggcaaagaccagcatttccccgtcttcatgaacgagacgtcggaagagc

SEQ ID NO: 43980 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaacaggtcaaactctataaagcagggcaaagaccagcatttccccgtcttcatgaacgagacgtcggaagagc

SEQ ID NO: 43981 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaactcaaactctataaagcagggcaaagaccagcatttccccgtcttcatgaacgagacgtcggaagagc

SEQ ID NO: 43982 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaacaactctataaagcagggcaaagaccagcatttccccgtcttcatgaacgagacgtcggaagagc

SEQ ID NO: 43983 - RNA, 296 nt, synthetic construct; identical to SEQ ID NO: 43873
  source 1..296: mol_type = other RNA

SEQ ID NO: 43984 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacaacataaagcagggcaaagaccagcatttccccgtcttcatgaacgagacgtcggaagagc

SEQ ID NO: 43985 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaacaagcagggcaaagaccagcatttccccgtcttcatgaacgagacgtcggaagagc

SEQ ID NO: 43986 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaccagggcaaagaccagcatttccccgtcttcatgaacgagacgtcggaagagc

SEQ ID NO: 43987 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagaacggcaaagaccagcatttccccgtcttcatgaacgagacgtcggaagagc

SEQ ID NO: 43988 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaacaaagaccagcatttccccgtcttcatgaacgagacgtcggaagagc

SEQ ID NO: 43989 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaacgaccagcatttccccgtcttcatgaacgagacgtcggaagagc

SEQ ID NO: 43990 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaaaccagcatttccccgtcttcatgaacgagacgtcggaagagc

SEQ ID NO: 43991 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacaaccatttccccgtcttcatgaacgagacgtcggaagagc

SEQ ID NO: 43992 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagaacttccccgtcttcatgaacgagacgtcggaagagc

SEQ ID NO: 43993 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcataaccccgtcttcatgaacgagacgtcggaagagc

SEQ ID NO: 43994 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcaacgtcttcatgaacgagacgtcggaagagc

SEQ ID NO: 43995 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccaacttcatgaacgagacgtcggaagagc

SEQ ID NO: 43996 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaacatgaacgagacgtcggaagagc

SEQ ID NO: 43997 - RNA, 296 nt, synthetic construct
  source 1..296: mol_type = other RNA
cgctcttccgcgtctcaagaggatgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43998 - RNA, 296 nt, synthetic construct
  source 1..296: mol_type = other RNA
cgctcttccgcgtctcaagagggacatgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 43999 - RNA, 296 nt, synthetic construct
  source 1..296: mol_type = other RNA
cgctcttccgcgtctcaagagggacatcatgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44000 - RNA, 296 nt, synthetic construct
  source 1..296: mol_type = other RNA
cgctcttccgcgtctcaagagggacatctcgatgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44001 - RNA, 296 nt, synthetic construct
  source 1..296: mol_type = other RNA
cgctcttccgcgtctcaagagggacatctcgcgaatgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44002 - RNA, 296 nt, synthetic construct
  source 1..296: mol_type = other RNA
cgctcttccgcgtctcaagagggacatctcgcgatttatggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44003 - RNA, 296 nt, synthetic construct
  source 1..296: mol_type = other RNA
cgctcttccgcgtctcaagagggacatctcgcgatttcttatgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44004 - RNA, 296 nt, synthetic construct
  source 1..296: mol_type = other RNA
cgctcttccgcgtctcaagagggacatctcgcgatttcttgagatgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44005 - RNA, 296 nt, synthetic construct
  source 1..296: mol_type = other RNA
cgctcttccgcgtctcaagagggacatctcgcgatttcttgagtctatgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44006 - RNA, 296 nt, synthetic construct
  source 1..296: mol_type = other RNA
cgctcttccgcgtctcaagagggacatctcgcgatttcttgagtctaacatggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44007 - RNA, 296 nt, synthetic construct
  source 1..296: mol_type = other RNA
cgctcttccgcgtctcaagagggacatctcgcgatttcttgagtctaaccccatgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44008 - RNA, 296 nt, synthetic construct; identical to SEQ ID NO: 43873
  source 1..296: mol_type = other RNA

SEQ ID NO: 44009 - RNA, 296 nt, synthetic construct
  source 1..296: mol_type = other RNA
cgctcttccgcgtctcaagagggacatctcgcgatttcttgagtctaaccccgtgatgatggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44010 - RNA, 296 nt, synthetic construct
  source 1..296: mol_type = other RNA
cgctcttccgcgtctcaagagggacatctcgcgatttcttgagtctaaccccgtgatgattatggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44011 - RNA, 296 nt, synthetic construct
  source 1..296: mol_type = other RNA
cgctcttccgcgtctcaagagggacatctcgcgatttcttgagtctaaccccgtgatgattgacatgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44012 - RNA, 296 nt, synthetic construct
  source 1..296: mol_type = other RNA
cgctcttccgcgtctcaagagggacatctcgcgatttcttgagtctaaccccgtgatgattgacgccatggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44013 - RNA, 296 nt, synthetic construct
  source 1..296: mol_type = other RNA
cgctcttccgcgtctcaagagggacatctcgcgatttcttgagtctaaccccgtgatgattgacgccaaaatggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44014 - RNA, 296 nt, synthetic construct
  source 1..296: mol_type = other RNA
cgctcttccgcgtctcaagagggacatctcgcgatttcttgagtctaaccccgtgatgattgacgccaaagaaatgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44015 - RNA, 296 nt, synthetic construct
  source 1..296: mol_type = other RNA
cgctcttccgcgtctcaagagggacatctcgcgatttcttgagtctaaccccgtgatgattgacgccaaagaagtgatggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44016 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctatggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44017 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctatgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44018 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaatgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44019 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacatggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44020 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggatgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44021 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccatgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44022 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtatgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44023 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacatgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44024 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcatgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44025 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggatgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44026 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtatgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44027 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacatgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44028 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttatgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44029 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctatgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44030 - RNA, 296 nt, synthetic construct; identical to SEQ ID NO: 43873
  source 1..296: mol_type = other RNA

SEQ ID NO: 44031 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgatgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44032 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacatgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44033 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggatgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44034 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctatggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44035 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgatgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44036 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaatgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44037 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccatggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44038 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactatgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44039 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgatggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44040 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatatgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44041 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatatgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44042 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagatggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44043 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgatgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44044 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagatgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44045 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgatggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44046 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaatgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44047 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagatgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44048 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtatggagcacggcagaatagccaagttcagcaaagtgaggaccattaccaccaggtcaaactctataaagcagggcaaagaccagcatttccccgtcttcatgaacgagacgtcggaagagc

SEQ ID NO: 44049 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgatgcacggcagaatagccaagttcagcaaagtgaggaccattaccaccaggtcaaactctataaagcagggcaaagaccagcatttccccgtcttcatgaacgagacgtcggaagagc

SEQ ID NO: 44050 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagatgggcagaatagccaagttcagcaaagtgaggaccattaccaccaggtcaaactctataaagcagggcaaagaccagcatttccccgtcttcatgaacgagacgtcggaagagc

SEQ ID NO: 44051 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacatgagaatagccaagttcagcaaagtgaggaccattaccaccaggtcaaactctataaagcagggcaaagaccagcatttccccgtcttcatgaacgagacgtcggaagagc

SEQ ID NO: 44052 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcatgatagccaagttcagcaaagtgaggaccattaccaccaggtcaaactctataaagcagggcaaagaccagcatttccccgtcttcatgaacgagacgtcggaagagc

SEQ ID NO: 44053 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatggccaagttcagcaaagtgaggaccattaccaccaggtcaaactctataaagcagggcaaagaccagcatttccccgtcttcatgaacgagacgtcggaagagc

SEQ ID NO: 44054 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataatgaagttcagcaaagtgaggaccattaccaccaggtcaaactctataaagcagggcaaagaccagcatttccccgtcttcatgaacgagacgtcggaagagc

SEQ ID NO: 44055 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccatgttcagcaaagtgaggaccattaccaccaggtcaaactctataaagcagggcaaagaccagcatttccccgtcttcatgaacgagacgtcggaagagc

SEQ ID NO: 44056 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagatgagcaaagtgaggaccattaccaccaggtcaaactctataaagcagggcaaagaccagcatttccccgtcttcatgaacgagacgtcggaagagc

SEQ ID NO: 44057 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcatgaaagtgaggaccattaccaccaggtcaaactctataaagcagggcaaagaccagcatttccccgtcttcatgaacgagacgtcggaagagc

SEQ ID NO: 44058 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcatggtgaggaccattaccaccaggtcaaactctataaagcagggcaaagaccagcatttccccgtcttcatgaacgagacgtcggaagagc

SEQ ID NO: 44059 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaatgaggaccattaccaccaggtcaaactctataaagcagggcaaagaccagcatttccccgtcttcatgaacgagacgtcggaagagc

SEQ ID NO: 44060 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgatgaccattaccaccaggtcaaactctataaagcagggcaaagaccagcatttccccgtcttcatgaacgagacgtcggaagagc

SEQ ID NO: 44061 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggatgattaccaccaggtcaaactctataaagcagggcaaagaccagcatttccccgtcttcatgaacgagacgtcggaagagc

SEQ ID NO: 44062 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatgaccaccaggtcaaactctataaagcagggcaaagaccagcatttccccgtcttcatgaacgagacgtcggaagagc

SEQ ID NO: 44063 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattatgaccaggtcaaactctataaagcagggcaaagaccagcatttccccgtcttcatgaacgagacgtcggaagagc

SEQ ID NO: 44064 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccatgaggtcaaactctataaagcagggcaaagaccagcatttccccgtcttcatgaacgagacgtcggaagagc

SEQ ID NO: 44065 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccatgtcaaactctataaagcagggcaaagaccagcatttccccgtcttcatgaacgagacgtcggaagagc

SEQ ID NO: 44066 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggatgaactctataaagcagggcaaagaccagcatttccccgtcttcatgaacgagacgtcggaagagc

SEQ ID NO: 44067 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaatgtctataaagcagggcaaagaccagcatttccccgtcttcatgaacgagacgtcggaagagc

SEQ ID NO: 44068 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacatgataaagcagggcaaagaccagcatttccccgtcttcatgaacgagacgtcggaagagc

SEQ ID NO: 44069 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatgaagcagggcaaagaccagcatttccccgtcttcatgaacgagacgtcggaagagc

SEQ ID NO: 44070 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataatgcagggcaaagaccagcatttccccgtcttcatgaacgagacgtcggaagagc

SEQ ID NO: 44071 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagatgggcaaagaccagcatttccccgtcttcatgaacgagacgtcggaagagc

SEQ ID NO: 44072 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagatgaaagaccagcatttccccgtcttcatgaacgagacgtcggaagagc

SEQ ID NO: 44073 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcatggaccagcatttccccgtcttcatgaacgagacgtcggaagagc

SEQ ID NO: 44074 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaatgcagcatttccccgtcttcatgaacgagacgtcggaagagc

SEQ ID NO: 44075 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacatgcatttccccgtcttcatgaacgagacgtcggaagagc

SEQ ID NO: 44076 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagatgttccccgtcttcatgaacgagacgtcggaagagc

SEQ ID NO: 44077 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatatgcccgtcttcatgaacgagacgtcggaagagc

SEQ ID NO: 44078 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcatggtcttcatgaacgagacgtcggaagagc

SEQ ID NO: 44079 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccatgttcatgaacgagacgtcggaagagc

SEQ ID NO: 44080 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcatgatgaacgagacgtcggaagagc

SEQ ID NO: 44081 - RNA, 296 nt, synthetic construct
  source 1..296: mol_type = other RNA
cgctcttccgcgtctcaagaggatcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44082 - RNA, 296 nt, synthetic construct; identical to SEQ ID NO: 43873
  source 1..296: mol_type = other RNA

SEQ ID NO: 44083 - RNA, 296 nt, synthetic construct
  source 1..296: mol_type = other RNA
cgctcttccgcgtctcaagagggacatcatccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44084 - RNA, 296 nt, synthetic construct
  source 1..296: mol_type = other RNA
cgctcttccgcgtctcaagagggacatctcgatctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44085 - RNA, 296 nt, synthetic construct
  source 1..296: mol_type = other RNA
cgctcttccgcgtctcaagagggacatctcgcgaatccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44086 - RNA, 296 nt, synthetic construct
  source 1..296: mol_type = other RNA
cgctcttccgcgtctcaagagggacatctcgcgatttatcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44087 - RNA, 296 nt, synthetic construct
  source 1..296: mol_type = other RNA
cgctcttccgcgtctcaagagggacatctcgcgatttcttatctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44088 - RNA, 296 nt, synthetic construct
  source 1..296: mol_type = other RNA
cgctcttccgcgtctcaagagggacatctcgcgatttcttgagatcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44089 - RNA, 296 nt, synthetic construct
  source 1..296: mol_type = other RNA
cgctcttccgcgtctcaagagggacatctcgcgatttcttgagtctatccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44090 - RNA, 296 nt, synthetic construct
  source 1..296: mol_type = other RNA
cgctcttccgcgtctcaagagggacatctcgcgatttcttgagtctaacatcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44091 - RNA, 296 nt, synthetic construct
  source 1..296: mol_type = other RNA
cgctcttccgcgtctcaagagggacatctcgcgatttcttgagtctaaccccatcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44092 - RNA, 296 nt, synthetic construct
  source 1..296: mol_type = other RNA
cgctcttccgcgtctcaagagggacatctcgcgatttcttgagtctaaccccgtgatcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44093 - RNA, 296 nt, synthetic construct
  source 1..296: mol_type = other RNA
cgctcttccgcgtctcaagagggacatctcgcgatttcttgagtctaaccccgtgatgatcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44094 - RNA, 296 nt, synthetic construct
  source 1..296: mol_type = other RNA
cgctcttccgcgtctcaagagggacatctcgcgatttcttgagtctaaccccgtgatgattatcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44095 - RNA, 296 nt, synthetic construct
  source 1..296: mol_type = other RNA
cgctcttccgcgtctcaagagggacatctcgcgatttcttgagtctaaccccgtgatgattgacatcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44096 - RNA, 296 nt, synthetic construct
  source 1..296: mol_type = other RNA
cgctcttccgcgtctcaagagggacatctcgcgatttcttgagtctaaccccgtgatgattgacgccatcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44097 - RNA, 296 nt, synthetic construct
  source 1..296: mol_type = other RNA
cgctcttccgcgtctcaagagggacatctcgcgatttcttgagtctaaccccgtgatgattgacgccaaaatcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44098 - RNA, 296 nt, synthetic construct
  source 1..296: mol_type = other RNA
cgctcttccgcgtctcaagagggacatctcgcgatttcttgagtctaaccccgtgatgattgacgccaaagaaatctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44099 - RNA, 296 nt, synthetic construct
  source 1..296: mol_type = other RNA
cgctcttccgcgtctcaagagggacatctcgcgatttcttgagtctaaccccgtgatgattgacgccaaagaagtgatcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44100 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctatcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44101 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctatccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44102 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaatcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44103 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacatcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44104 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggatccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44105 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccatctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44106 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtatcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44107 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacatctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44108 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcatcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44109 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggatcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44110 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtatccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44111 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacatccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44112 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttatcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44113 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctatcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44114 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44115 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgatcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44116 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacatccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44117 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggatcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44118 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctatcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44119 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgatctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44120 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaatcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44121 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccatcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44122 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactatcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44123 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgatcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44124 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatatcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44125 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatatcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44126 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagatcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44127 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgatcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44128 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagatccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44129 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgatcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44130 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaatctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44131 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagatcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44132 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtatcgagcacggcagaatagccaagttcagcaaagtgaggaccattaccaccaggtcaaactctataaagcagggcaaagaccagcatttccccgtcttcatgaacgagacgtcggaagagc

SEQ ID NO: 44133 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgatccacggcagaatagccaagttcagcaaagtgaggaccattaccaccaggtcaaactctataaagcagggcaaagaccagcatttccccgtcttcatgaacgagacgtcggaagagc

SEQ ID NO: 44134 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagatcggcagaatagccaagttcagcaaagtgaggaccattaccaccaggtcaaactctataaagcagggcaaagaccagcatttccccgtcttcatgaacgagacgtcggaagagc

SEQ ID NO: 44135 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacatcagaatagccaagttcagcaaagtgaggaccattaccaccaggtcaaactctataaagcagggcaaagaccagcatttccccgtcttcatgaacgagacgtcggaagagc

SEQ ID NO: 44136 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcatcatagccaagttcagcaaagtgaggaccattaccaccaggtcaaactctataaagcagggcaaagaccagcatttccccgtcttcatgaacgagacgtcggaagagc

SEQ ID NO: 44137 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatcgccaagttcagcaaagtgaggaccattaccaccaggtcaaactctataaagcagggcaaagaccagcatttccccgtcttcatgaacgagacgtcggaagagc

SEQ ID NO: 44138 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataatcaagttcagcaaagtgaggaccattaccaccaggtcaaactctataaagcagggcaaagaccagcatttccccgtcttcatgaacgagacgtcggaagagc

SEQ ID NO: 44139 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccatcttcagcaaagtgaggaccattaccaccaggtcaaactctataaagcagggcaaagaccagcatttccccgtcttcatgaacgagacgtcggaagagc

SEQ ID NO: 44140 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagatcagcaaagtgaggaccattaccaccaggtcaaactctataaagcagggcaaagaccagcatttccccgtcttcatgaacgagacgtcggaagagc

SEQ ID NO: 44141 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcatcaaagtgaggaccattaccaccaggtcaaactctataaagcagggcaaagaccagcatttccccgtcttcatgaacgagacgtcggaagagc

SEQ ID NO: 44142 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcatcgtgaggaccattaccaccaggtcaaactctataaagcagggcaaagaccagcatttccccgtcttcatgaacgagacgtcggaagagc

SEQ ID NO: 44143 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaatcaggaccattaccaccaggtcaaactctataaagcagggcaaagaccagcatttccccgtcttcatgaacgagacgtcggaagagc

SEQ ID NO: 44144 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgatcaccattaccaccaggtcaaactctataaagcagggcaaagaccagcatttccccgtcttcatgaacgagacgtcggaagagc

SEQ ID NO: 44145 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggatcattaccaccaggtcaaactctataaagcagggcaaagaccagcatttccccgtcttcatgaacgagacgtcggaagagc

SEQ ID NO: 44146 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatcaccaccaggtcaaactctataaagcagggcaaagaccagcatttccccgtcttcatgaacgagacgtcggaagagc

SEQ ID NO: 44147 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattatcaccaggtcaaactctataaagcagggcaaagaccagcatttccccgtcttcatgaacgagacgtcggaagagc

SEQ ID NO: 44148 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccatcaggtcaaactctataaagcagggcaaagaccagcatttccccgtcttcatgaacgagacgtcggaagagc

SEQ ID NO: 44149 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccatctcaaactctataaagcagggcaaagaccagcatttccccgtcttcatgaacgagacgtcggaagagc

SEQ ID NO: 44150 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggatcaactctataaagcagggcaaagaccagcatttccccgtcttcatgaacgagacgtcggaagagc

SEQ ID NO: 44151 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaatctctataaagcagggcaaagaccagcatttccccgtcttcatgaacgagacgtcggaagagc

SEQ ID NO: 44152 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacatcataaagcagggcaaagaccagcatttccccgtcttcatgaacgagacgtcggaagagc

SEQ ID NO: 44153 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatcaagcagggcaaagaccagcatttccccgtcttcatgaacgagacgtcggaagagc

SEQ ID NO: 44154 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataatccagggcaaagaccagcatttccccgtcttcatgaacgagacgtcggaagagc

SEQ ID NO: 44155 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagatcggcaaagaccagcatttccccgtcttcatgaacgagacgtcggaagagc

SEQ ID NO: 44156 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagatcaaagaccagcatttccccgtcttcatgaacgagacgtcggaagagc

SEQ ID NO: 44157 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcatcgaccagcatttccccgtcttcatgaacgagacgtcggaagagc

SEQ ID NO: 44158 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaatccagcatttccccgtcttcatgaacgagacgtcggaagagc

SEQ ID NO: 44159 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacatccatttccccgtcttcatgaacgagacgtcggaagagc

SEQ ID NO: 44160 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagatcttccccgtcttcatgaacgagacgtcggaagagc

SEQ ID NO: 44161 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatatccccgtcttcatgaacgagacgtcggaagagc

SEQ ID NO: 44162 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcatcgtcttcatgaacgagacgtcggaagagc

SEQ ID NO: 44163 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccatcttcatgaacgagacgtcggaagagc

SEQ ID NO: 44164 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcatcatgaacgagacgtcggaagagc

SEQ ID NO: 44165 - RNA, 296 nt, synthetic construct
  source 1..296: mol_type = other RNA
cgctcttccgcgtctcaagaggaggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44166 - RNA, 296 nt, synthetic construct
  source 1..296: mol_type = other RNA
cgctcttccgcgtctcaagagggacaggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44167 - RNA, 296 nt, synthetic construct
  source 1..296: mol_type = other RNA
cgctcttccgcgtctcaagagggacatcaggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44168 - RNA, 296 nt, synthetic construct
  source 1..296: mol_type = other RNA
cgctcttccgcgtctcaagagggacatctcgaggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44169 - RNA, 296 nt, synthetic construct
  source 1..296: mol_type = other RNA
cgctcttccgcgtctcaagagggacatctcgcgaaggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44170 - RNA, 296 nt, synthetic construct
  source 1..296: mol_type = other RNA
cgctcttccgcgtctcaagagggacatctcgcgatttagggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44171 - RNA, 296 nt, synthetic construct
  source 1..296: mol_type = other RNA
cgctcttccgcgtctcaagagggacatctcgcgatttcttaggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44172 - RNA, 296 nt, synthetic construct
  source 1..296: mol_type = other RNA
cgctcttccgcgtctcaagagggacatctcgcgatttcttgagaggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44173 - RNA, 296 nt, synthetic construct
  source 1..296: mol_type = other RNA
cgctcttccgcgtctcaagagggacatctcgcgatttcttgagtctaggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44174 - RNA, 296 nt, synthetic construct
  source 1..296: mol_type = other RNA
cgctcttccgcgtctcaagagggacatctcgcgatttcttgagtctaacagggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44175 - RNA, 296 nt, synthetic construct
  source 1..296: mol_type = other RNA
cgctcttccgcgtctcaagagggacatctcgcgatttcttgagtctaaccccaggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44176 - RNA, 296 nt, synthetic construct
  source 1..296: mol_type = other RNA
cgctcttccgcgtctcaagagggacatctcgcgatttcttgagtctaaccccgtgaggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44177 - RNA, 296 nt, synthetic construct
  source 1..296: mol_type = other RNA
cgctcttccgcgtctcaagagggacatctcgcgatttcttgagtctaaccccgtgatgagggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44178 - RNA, 296 nt, synthetic construct
  source 1..296: mol_type = other RNA
cgctcttccgcgtctcaagagggacatctcgcgatttcttgagtctaaccccgtgatgattagggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44179 - RNA, 296 nt, synthetic construct
  source 1..296: mol_type = other RNA
cgctcttccgcgtctcaagagggacatctcgcgatttcttgagtctaaccccgtgatgattgacaggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44180 - RNA, 296 nt, synthetic construct
  source 1..296: mol_type = other RNA
cgctcttccgcgtctcaagagggacatctcgcgatttcttgagtctaaccccgtgatgattgacgccagggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44181 - RNA, 296 nt, synthetic construct
  source 1..296: mol_type = other RNA
cgctcttccgcgtctcaagagggacatctcgcgatttcttgagtctaaccccgtgatgattgacgccaaaagggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44182 - RNA, 296 nt, synthetic construct
  source 1..296: mol_type = other RNA
cgctcttccgcgtctcaagagggacatctcgcgatttcttgagtctaaccccgtgatgattgacgccaaagaaaggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44183 - RNA, 296 nt, synthetic construct
  source 1..296: mol_type = other RNA
cgctcttccgcgtctcaagagggacatctcgcgatttcttgagtctaaccccgtgatgattgacgccaaagaagtgagggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44184 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctagggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44185 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctaggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44186 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaaggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44187 - RNA, 296 nt, synthetic construct; identical to SEQ ID NO: 43873
  source 1..296: mol_type = other RNA

SEQ ID NO: 44188 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggaggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44189 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccaggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44190 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtaggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44191 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacaggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44192 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcaggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44193 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggaggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44194 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44195 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacaggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44196 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttaggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44197 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44198 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44199 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44200 - RNA, 296 nt, synthetic construct; identical to SEQ ID NO: 43873
  source 1..296: mol_type = other RNA

SEQ ID NO: 44201 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggaggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44202 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctagggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44203 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgaggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44204 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaaggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44205 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccagggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44206 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44207 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgagggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44208 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44209 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44210 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagagggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44211 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgaggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44212 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagaggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44213 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgagggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44214 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaaggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44215 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagaggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44216 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtagggagcacggcagaatagccaagttcagcaaagtgaggaccattaccaccaggtcaaactctataaagcagggcaaagaccagcatttccccgtcttcatgaacgagacgtcggaagagc

SEQ ID NO: 44217 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgaggcacggcagaatagccaagttcagcaaagtgaggaccattaccaccaggtcaaactctataaagcagggcaaagaccagcatttccccgtcttcatgaacgagacgtcggaagagc

SEQ ID NO: 44218 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagaggggcagaatagccaagttcagcaaagtgaggaccattaccaccaggtcaaactctataaagcagggcaaagaccagcatttccccgtcttcatgaacgagacgtcggaagagc

SEQ ID NO: 44219 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaggagaatagccaagttcagcaaagtgaggaccattaccaccaggtcaaactctataaagcagggcaaagaccagcatttccccgtcttcatgaacgagacgtcggaagagc

SEQ ID NO: 44220 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaggatagccaagttcagcaaagtgaggaccattaccaccaggtcaaactctataaagcagggcaaagaccagcatttccccgtcttcatgaacgagacgtcggaagagc

SEQ ID NO: 44221 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaagggccaagttcagcaaagtgaggaccattaccaccaggtcaaactctataaagcagggcaaagaccagcatttccccgtcttcatgaacgagacgtcggaagagc

SEQ ID NO: 44222 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaggaagttcagcaaagtgaggaccattaccaccaggtcaaactctataaagcagggcaaagaccagcatttccccgtcttcatgaacgagacgtcggaagagc

SEQ ID NO: 44223 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaggttcagcaaagtgaggaccattaccaccaggtcaaactctataaagcagggcaaagaccagcatttccccgtcttcatgaacgagacgtcggaagagc

SEQ ID NO: 44224 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaggagcaaagtgaggaccattaccaccaggtcaaactctataaagcagggcaaagaccagcatttccccgtcttcatgaacgagacgtcggaagagc

SEQ ID NO: 44225 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaggaaagtgaggaccattaccaccaggtcaaactctataaagcagggcaaagaccagcatttccccgtcttcatgaacgagacgtcggaagagc

SEQ ID NO: 44226 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcagggtgaggaccattaccaccaggtcaaactctataaagcagggcaaagaccagcatttccccgtcttcatgaacgagacgtcggaagagc

SEQ ID NO: 44227 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaggaggaccattaccaccaggtcaaactctataaagcagggcaaagaccagcatttccccgtcttcatgaacgagacgtcggaagagc

SEQ ID NO: 44228 - RNA, 296 nt, synthetic construct; identical to SEQ ID NO: 43873
  source 1..296: mol_type = other RNA

SEQ ID NO: 44229 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaggattaccaccaggtcaaactctataaagcagggcaaagaccagcatttccccgtcttcatgaacgagacgtcggaagagc

SEQ ID NO: 44230 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaggaccaccaggtcaaactctataaagcagggcaaagaccagcatttccccgtcttcatgaacgagacgtcggaagagc

SEQ ID NO: 44231 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaggaccaggtcaaactctataaagcagggcaaagaccagcatttccccgtcttcatgaacgagacgtcggaagagc

SEQ ID NO: 44232 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaggaggtcaaactctataaagcagggcaaagaccagcatttccccgtcttcatgaacgagacgtcggaagagc

SEQ ID NO: 44233 - RNA, 296 nt, synthetic construct; identical to SEQ ID NO: 43873
  source 1..296: mol_type = other RNA

SEQ ID NO: 44234 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaggaactctataaagcagggcaaagaccagcatttccccgtcttcatgaacgagacgtcggaagagc

SEQ ID NO: 44235 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaggtctataaagcagggcaaagaccagcatttccccgtcttcatgaacgagacgtcggaagagc

SEQ ID NO: 44236 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacaggataaagcagggcaaagaccagcatttccccgtcttcatgaacgagacgtcggaagagc

SEQ ID NO: 44237 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaggaagcagggcaaagaccagcatttccccgtcttcatgaacgagacgtcggaagagc

SEQ ID NO: 44238 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaggcagggcaaagaccagcatttccccgtcttcatgaacgagacgtcggaagagc

SEQ ID NO: 44239 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagaggggcaaagaccagcatttccccgtcttcatgaacgagacgtcggaagagc

SEQ ID NO: 44240 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaggaaagaccagcatttccccgtcttcatgaacgagacgtcggaagagc

SEQ ID NO: 44241 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcagggaccagcatttccccgtcttcatgaacgagacgtcggaagagc

SEQ ID NO: 44242 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaaggcagcatttccccgtcttcatgaacgagacgtcggaagagc

SEQ ID NO: 44243 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacaggcatttccccgtcttcatgaacgagacgtcggaagagc

SEQ ID NO: 44244 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagaggttccccgtcttcatgaacgagacgtcggaagagc

SEQ ID NO: 44245 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcataggcccgtcttcatgaacgagacgtcggaagagc

SEQ ID NO: 44246 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcagggtcttcatgaacgagacgtcggaagagc

SEQ ID NO: 44247 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccaggttcatgaacgagacgtcggaagagc

SEQ ID NO: 44248 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaggatgaacgagacgtcggaagagc

SEQ ID NO: 44249 - RNA, 296 nt, synthetic construct
  source 1..296: mol_type = other RNA
cgctcttccgcgtctcaagaggagcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44250 - RNA, 296 nt, synthetic construct
  source 1..296: mol_type = other RNA
cgctcttccgcgtctcaagagggacagctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44251 - RNA, 296 nt, synthetic construct
  source 1..296: mol_type = other RNA
cgctcttccgcgtctcaagagggacatcagccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44252 - RNA, 296 nt, synthetic construct
  source 1..296: mol_type = other RNA
cgctcttccgcgtctcaagagggacatctcgagctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44253 - RNA, 296 nt, synthetic construct
  source 1..296: mol_type = other RNA
cgctcttccgcgtctcaagagggacatctcgcgaagccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44254 - RNA, 296 nt, synthetic construct
  source 1..296: mol_type = other RNA
cgctcttccgcgtctcaagagggacatctcgcgatttagcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44255 - RNA, 296 nt, synthetic construct
  source 1..296: mol_type = other RNA
cgctcttccgcgtctcaagagggacatctcgcgatttcttagctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44256 - RNA, 296 nt, synthetic construct
  source 1..296: mol_type = other RNA
cgctcttccgcgtctcaagagggacatctcgcgatttcttgagagcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44257 - RNA, 296 nt, synthetic construct
  source 1..296: mol_type = other RNA
cgctcttccgcgtctcaagagggacatctcgcgatttcttgagtctagccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44258 - RNA, 296 nt, synthetic construct
  source 1..296: mol_type = other RNA
cgctcttccgcgtctcaagagggacatctcgcgatttcttgagtctaacagcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44259 - RNA, 296 nt, synthetic construct
  source 1..296: mol_type = other RNA
cgctcttccgcgtctcaagagggacatctcgcgatttcttgagtctaaccccagcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44260 - RNA, 296 nt, synthetic construct
  source 1..296: mol_type = other RNA
cgctcttccgcgtctcaagagggacatctcgcgatttcttgagtctaaccccgtgagcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44261 - RNA, 296 nt, synthetic construct
  source 1..296: mol_type = other RNA
cgctcttccgcgtctcaagagggacatctcgcgatttcttgagtctaaccccgtgatgagcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44262 - RNA, 296 nt, synthetic construct
  source 1..296: mol_type = other RNA
cgctcttccgcgtctcaagagggacatctcgcgatttcttgagtctaaccccgtgatgattagcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44263 - RNA, 296 nt, synthetic construct
  source 1..296: mol_type = other RNA
cgctcttccgcgtctcaagagggacatctcgcgatttcttgagtctaaccccgtgatgattgacagcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44264 - RNA, 296 nt, synthetic construct
  source 1..296: mol_type = other RNA
cgctcttccgcgtctcaagagggacatctcgcgatttcttgagtctaaccccgtgatgattgacgccagcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44265 - RNA, 296 nt, synthetic construct
  source 1..296: mol_type = other RNA
cgctcttccgcgtctcaagagggacatctcgcgatttcttgagtctaaccccgtgatgattgacgccaaaagcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44266 - RNA, 296 nt, synthetic construct
  source 1..296: mol_type = other RNA
cgctcttccgcgtctcaagagggacatctcgcgatttcttgagtctaaccccgtgatgattgacgccaaagaaagctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44267 - RNA, 296 nt, synthetic construct
  source 1..296: mol_type = other RNA
cgctcttccgcgtctcaagagggacatctcgcgatttcttgagtctaaccccgtgatgattgacgccaaagaagtgagcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44268 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctagcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44269 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctagccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44270 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaagcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44271 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44272 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggagccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44273 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccagctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44274 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtagcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44275 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacagctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44276 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcagcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44277 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggagcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44278 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtagccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44279 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacagccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44280 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttagcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44281 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctagcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44282 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcagcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44283 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgagcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44284 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44285 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggagcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44286 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctagcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44287 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgagctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44288 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaagcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44289 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccagcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44290 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactagcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44291 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgagcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44292 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatagcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44293 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatagcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44294 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagagcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44295 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgagcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44296 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagagccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44297 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgagcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44298 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaagctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44299 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagagcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44300 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtagcgagcacggcagaatagccaagttcagcaaagtgaggaccattaccaccaggtcaaactctataaagcagggcaaagaccagcatttccccgtcttcatgaacgagacgtcggaagagc

SEQ ID NO: 44301 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgagccacggcagaatagccaagttcagcaaagtgaggaccattaccaccaggtcaaactctataaagcagggcaaagaccagcatttccccgtcttcatgaacgagacgtcggaagagc

SEQ ID NO: 44302 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagagcggcagaatagccaagttcagcaaagtgaggaccattaccaccaggtcaaactctataaagcagggcaaagaccagcatttccccgtcttcatgaacgagacgtcggaagagc

SEQ ID NO: 44303 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacagcagaatagccaagttcagcaaagtgaggaccattaccaccaggtcaaactctataaagcagggcaaagaccagcatttccccgtcttcatgaacgagacgtcggaagagc

SEQ ID NO: 44304 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagcatagccaagttcagcaaagtgaggaccattaccaccaggtcaaactctataaagcagggcaaagaccagcatttccccgtcttcatgaacgagacgtcggaagagc

SEQ ID NO: 44305 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaagcgccaagttcagcaaagtgaggaccattaccaccaggtcaaactctataaagcagggcaaagaccagcatttccccgtcttcatgaacgagacgtcggaagagc

SEQ ID NO: 44306 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataagcaagttcagcaaagtgaggaccattaccaccaggtcaaactctataaagcagggcaaagaccagcatttccccgtcttcatgaacgagacgtcggaagagc

SEQ ID NO: 44307 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccagcttcagcaaagtgaggaccattaccaccaggtcaaactctataaagcagggcaaagaccagcatttccccgtcttcatgaacgagacgtcggaagagc

SEQ ID NO: 44308 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagagcagcaaagtgaggaccattaccaccaggtcaaactctataaagcagggcaaagaccagcatttccccgtcttcatgaacgagacgtcggaagagc

SEQ ID NO: 44309 - RNA, 296 nt, synthetic construct; identical to SEQ ID NO: 43873
  source 1..296: mol_type = other RNA

SEQ ID NO: 44310 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcagcgtgaggaccattaccaccaggtcaaactctataaagcagggcaaagaccagcatttccccgtcttcatgaacgagacgtcggaagagc

SEQ ID NO: 44311 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaagcaggaccattaccaccaggtcaaactctataaagcagggcaaagaccagcatttccccgtcttcatgaacgagacgtcggaagagc

SEQ ID NO: 44312 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagcaccattaccaccaggtcaaactctataaagcagggcaaagaccagcatttccccgtcttcatgaacgagacgtcggaagagc

SEQ ID NO: 44313 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggagcattaccaccaggtcaaactctataaagcagggcaaagaccagcatttccccgtcttcatgaacgagacgtcggaagagc

SEQ ID NO: 44314 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccagcaccaccaggtcaaactctataaagcagggcaaagaccagcatttccccgtcttcatgaacgagacgtcggaagagc

SEQ ID NO: 44315 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattagcaccaggtcaaactctataaagcagggcaaagaccagcatttccccgtcttcatgaacgagacgtcggaagagc

SEQ ID NO: 44316 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccagcaggtcaaactctataaagcagggcaaagaccagcatttccccgtcttcatgaacgagacgtcggaagagc

SEQ ID NO: 44317 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagctcaaactctataaagcagggcaaagaccagcatttccccgtcttcatgaacgagacgtcggaagagc

SEQ ID NO: 44318 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggagcaactctataaagcagggcaaagaccagcatttccccgtcttcatgaacgagacgtcggaagagc

SEQ ID NO: 44319 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaagctctataaagcagggcaaagaccagcatttccccgtcttcatgaacgagacgtcggaagagc

SEQ ID NO: 44320 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacagcataaagcagggcaaagaccagcatttccccgtcttcatgaacgagacgtcggaagagc

SEQ ID NO: 44321 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctagcaagcagggcaaagaccagcatttccccgtcttcatgaacgagacgtcggaagagc

SEQ ID NO: 44322 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataagccagggcaaagaccagcatttccccgtcttcatgaacgagacgtcggaagagc

SEQ ID NO: 44323 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagagcggcaaagaccagcatttccccgtcttcatgaacgagacgtcggaagagc

SEQ ID NO: 44324 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagagcaaagaccagcatttccccgtcttcatgaacgagacgtcggaagagc

SEQ ID NO: 44325 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcagcgaccagcatttccccgtcttcatgaacgagacgtcggaagagc

SEQ ID NO: 44326 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaagccagcatttccccgtcttcatgaacgagacgtcggaagagc

SEQ ID NO: 44327 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacagccatttccccgtcttcatgaacgagacgtcggaagagc

SEQ ID NO: 44328 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagagcttccccgtcttcatgaacgagacgtcggaagagc

SEQ ID NO: 44329 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatagccccgtcttcatgaacgagacgtcggaagagc

SEQ ID NO: 44330 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcagcgtcttcatgaacgagacgtcggaagagc

SEQ ID NO: 44331 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccagcttcatgaacgagacgtcggaagagc

SEQ ID NO: 44332 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcagcatgaacgagacgtcggaagagc

SEQ ID NO: 44333 - RNA, 296 nt, synthetic construct
  source 1..296: mol_type = other RNA
cgctcttccgcgtctcaagaggacgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44334 - RNA, 296 nt, synthetic construct
  source 1..296: mol_type = other RNA
cgctcttccgcgtctcaagagggacacgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44335 - RNA, 296 nt, synthetic construct
  source 1..296: mol_type = other RNA
cgctcttccgcgtctcaagagggacatcacgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44336 - RNA, 296 nt, synthetic construct
  source 1..296: mol_type = other RNA
cgctcttccgcgtctcaagagggacatctcgacgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44337 - RNA, 296 nt, synthetic construct
  source 1..296: mol_type = other RNA
cgctcttccgcgtctcaagagggacatctcgcgaacgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44338 - RNA, 296 nt, synthetic construct
  source 1..296: mol_type = other RNA
cgctcttccgcgtctcaagagggacatctcgcgatttacggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44339 - RNA, 296 nt, synthetic construct
  source 1..296: mol_type = other RNA
cgctcttccgcgtctcaagagggacatctcgcgatttcttacgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44340 - RNA, 296 nt, synthetic construct
  source 1..296: mol_type = other RNA
cgctcttccgcgtctcaagagggacatctcgcgatttcttgagacgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44341 - RNA, 296 nt, synthetic construct
  source 1..296: mol_type = other RNA
cgctcttccgcgtctcaagagggacatctcgcgatttcttgagtctacgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44342 - RNA, 296 nt, synthetic construct
  source 1..296: mol_type = other RNA
cgctcttccgcgtctcaagagggacatctcgcgatttcttgagtctaacacggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44343 - RNA, 296 nt, synthetic construct
  source 1..296: mol_type = other RNA
cgctcttccgcgtctcaagagggacatctcgcgatttcttgagtctaaccccacgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44344 - RNA, 296 nt, synthetic construct
  source 1..296: mol_type = other RNA
cgctcttccgcgtctcaagagggacatctcgcgatttcttgagtctaaccccgtgacgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44345 - RNA, 296 nt, synthetic construct
  source 1..296: mol_type = other RNA
cgctcttccgcgtctcaagagggacatctcgcgatttcttgagtctaaccccgtgatgacggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44346 - RNA, 296 nt, synthetic construct
  source 1..296: mol_type = other RNA
cgctcttccgcgtctcaagagggacatctcgcgatttcttgagtctaaccccgtgatgattacggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44347 - RNA, 296 nt, synthetic construct
  source 1..296: mol_type = other RNA
cgctcttccgcgtctcaagagggacatctcgcgatttcttgagtctaaccccgtgatgattgacacgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44348 - RNA, 296 nt, synthetic construct
  source 1..296: mol_type = other RNA
cgctcttccgcgtctcaagagggacatctcgcgatttcttgagtctaaccccgtgatgattgacgccacggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44349 - RNA, 296 nt, synthetic construct
  source 1..296: mol_type = other RNA
cgctcttccgcgtctcaagagggacatctcgcgatttcttgagtctaaccccgtgatgattgacgccaaaacggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44350 - RNA, 296 nt, synthetic construct
  source 1..296: mol_type = other RNA
cgctcttccgcgtctcaagagggacatctcgcgatttcttgagtctaaccccgtgatgattgacgccaaagaaacgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44351 - RNA, 296 nt, synthetic construct
  source 1..296: mol_type = other RNA
cgctcttccgcgtctcaagagggacatctcgcgatttcttgagtctaaccccgtgatgattgacgccaaagaagtgacggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44352 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctacggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44353 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctacgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44354 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaacgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44355 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacacggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44356 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggacgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44357 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccacgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44358 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtacgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44359 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacacgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44360 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcacgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44361 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggacgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44362 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtacgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44363 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacacgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44364 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttacgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44365 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctacgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44366 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcacgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44367 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgacgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44368 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacacgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44369 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggacgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44370 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctacggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44371 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgacgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44372 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaacgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44373 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44374 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactacgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44375 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgacggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44376 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatacgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44377 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatacgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44378 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagacggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44379 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgacgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44380 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagacgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44381 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgacggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44382 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaacgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44383 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagacgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44384 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtacggagcacggcagaatagccaagttcagcaaagtgaggaccattaccaccaggtcaaactctataaagcagggcaaagaccagcatttccccgtcttcatgaacgagacgtcggaagagc

SEQ ID NO: 44385 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgacgcacggcagaatagccaagttcagcaaagtgaggaccattaccaccaggtcaaactctataaagcagggcaaagaccagcatttccccgtcttcatgaacgagacgtcggaagagc

SEQ ID NO: 44386 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagacgggcagaatagccaagttcagcaaagtgaggaccattaccaccaggtcaaactctataaagcagggcaaagaccagcatttccccgtcttcatgaacgagacgtcggaagagc

SEQ ID NO: 44387 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacacgagaatagccaagttcagcaaagtgaggaccattaccaccaggtcaaactctataaagcagggcaaagaccagcatttccccgtcttcatgaacgagacgtcggaagagc

SEQ ID NO: 44388 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcacgatagccaagttcagcaaagtgaggaccattaccaccaggtcaaactctataaagcagggcaaagaccagcatttccccgtcttcatgaacgagacgtcggaagagc

SEQ ID NO: 44389 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaacggccaagttcagcaaagtgaggaccattaccaccaggtcaaactctataaagcagggcaaagaccagcatttccccgtcttcatgaacgagacgtcggaagagc

SEQ ID NO: 44390 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataacgaagttcagcaaagtgaggaccattaccaccaggtcaaactctataaagcagggcaaagaccagcatttccccgtcttcatgaacgagacgtcggaagagc

SEQ ID NO: 44391 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccacgttcagcaaagtgaggaccattaccaccaggtcaaactctataaagcagggcaaagaccagcatttccccgtcttcatgaacgagacgtcggaagagc

SEQ ID NO: 44392 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagacgagcaaagtgaggaccattaccaccaggtcaaactctataaagcagggcaaagaccagcatttccccgtcttcatgaacgagacgtcggaagagc

SEQ ID NO: 44393 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcacgaaagtgaggaccattaccaccaggtcaaactctataaagcagggcaaagaccagcatttccccgtcttcatgaacgagacgtcggaagagc

SEQ ID NO: 44394 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcacggtgaggaccattaccaccaggtcaaactctataaagcagggcaaagaccagcatttccccgtcttcatgaacgagacgtcggaagagc

SEQ ID NO: 44395 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaacgaggaccattaccaccaggtcaaactctataaagcagggcaaagaccagcatttccccgtcttcatgaacgagacgtcggaagagc

SEQ ID NO: 44396 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgacgaccattaccaccaggtcaaactctataaagcagggcaaagaccagcatttccccgtcttcatgaacgagacgtcggaagagc

SEQ ID NO: 44397 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacgattaccaccaggtcaaactctataaagcagggcaaagaccagcatttccccgtcttcatgaacgagacgtcggaagagc

SEQ ID NO: 44398 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccacgaccaccaggtcaaactctataaagcagggcaaagaccagcatttccccgtcttcatgaacgagacgtcggaagagc

SEQ ID NO: 44399 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacgaccaggtcaaactctataaagcagggcaaagaccagcatttccccgtcttcatgaacgagacgtcggaagagc

SEQ ID NO: 44400 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacgaggtcaaactctataaagcagggcaaagaccagcatttccccgtcttcatgaacgagacgtcggaagagc

SEQ ID NO: 44401 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccacgtcaaactctataaagcagggcaaagaccagcatttccccgtcttcatgaacgagacgtcggaagagc

SEQ ID NO: 44402 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggacgaactctataaagcagggcaaagaccagcatttccccgtcttcatgaacgagacgtcggaagagc

SEQ ID NO: 44403 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaacgtctataaagcagggcaaagaccagcatttccccgtcttcatgaacgagacgtcggaagagc

SEQ ID NO: 44404 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacacgataaagcagggcaaagaccagcatttccccgtcttcatgaacgagacgtcggaagagc

SEQ ID NO: 44405 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctacgaagcagggcaaagaccagcatttccccgtcttcatgaacgagacgtcggaagagc

SEQ ID NO: 44406 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataacgcagggcaaagaccagcatttccccgtcttcatgaacgagacgtcggaagagc

SEQ ID NO: 44407 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagacgggcaaagaccagcatttccccgtcttcatgaacgagacgtcggaagagc

SEQ ID NO: 44408 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagacgaaagaccagcatttccccgtcttcatgaacgagacgtcggaagagc

SEQ ID NO: 44409 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcacggaccagcatttccccgtcttcatgaacgagacgtcggaagagc

SEQ ID NO: 44410 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaacgcagcatttccccgtcttcatgaacgagacgtcggaagagc

SEQ ID NO: 44411 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacacgcatttccccgtcttcatgaacgagacgtcggaagagc

SEQ ID NO: 44412 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagacgttccccgtcttcatgaacgagacgtcggaagagc

SEQ ID NO: 44413 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatacgcccgtcttcatgaacgagacgtcggaagagc

SEQ ID NO: 44414 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcacggtcttcatgaacgagacgtcggaagagc

SEQ ID NO: 44415 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccacgttcatgaacgagacgtcggaagagc

SEQ ID NO: 44416 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcacgatgaacgagacgtcggaagagc

SEQ ID NO: 44417 - RNA, 296 nt, synthetic construct
  source 1..296: mol_type = other RNA
cgctcttccgcgtctcaagaggaccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44418 - RNA, 296 nt, synthetic construct
  source 1..296: mol_type = other RNA
cgctcttccgcgtctcaagagggacacctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44419 - RNA, 296 nt, synthetic construct
  source 1..296: mol_type = other RNA
cgctcttccgcgtctcaagagggacatcacccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44420 - RNA, 296 nt, synthetic construct
  source 1..296: mol_type = other RNA
cgctcttccgcgtctcaagagggacatctcgacctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44421 - RNA, 296 nt, synthetic construct
  source 1..296: mol_type = other RNA
cgctcttccgcgtctcaagagggacatctcgcgaacccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44422 - RNA, 296 nt, synthetic construct
  source 1..296: mol_type = other RNA
cgctcttccgcgtctcaagagggacatctcgcgatttaccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44423 - RNA, 296 nt, synthetic construct
  source 1..296: mol_type = other RNA
cgctcttccgcgtctcaagagggacatctcgcgatttcttacctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44424 - RNA, 296 nt, synthetic construct
  source 1..296: mol_type = other RNA
cgctcttccgcgtctcaagagggacatctcgcgatttcttgagaccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44425 - RNA, 296 nt, synthetic construct
  source 1..296: mol_type = other RNA
cgctcttccgcgtctcaagagggacatctcgcgatttcttgagtctacccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44426 - RNA, 296 nt, synthetic construct
  source 1..296: mol_type = other RNA
cgctcttccgcgtctcaagagggacatctcgcgatttcttgagtctaacaccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44427 - RNA, 296 nt, synthetic construct
  source 1..296: mol_type = other RNA
cgctcttccgcgtctcaagagggacatctcgcgatttcttgagtctaaccccaccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44428 - RNA, 296 nt, synthetic construct
  source 1..296: mol_type = other RNA
cgctcttccgcgtctcaagagggacatctcgcgatttcttgagtctaaccccgtgaccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44429 - RNA, 296 nt, synthetic construct
  source 1..296: mol_type = other RNA
cgctcttccgcgtctcaagagggacatctcgcgatttcttgagtctaaccccgtgatgaccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44430 - RNA, 296 nt, synthetic construct
  source 1..296: mol_type = other RNA
cgctcttccgcgtctcaagagggacatctcgcgatttcttgagtctaaccccgtgatgattaccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44431 - RNA, 296 nt, synthetic construct
  source 1..296: mol_type = other RNA
cgctcttccgcgtctcaagagggacatctcgcgatttcttgagtctaaccccgtgatgattgacaccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44432 - RNA, 296 nt, synthetic construct
  source 1..296: mol_type = other RNA
cgctcttccgcgtctcaagagggacatctcgcgatttcttgagtctaaccccgtgatgattgacgccaccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44433 - RNA, 296 nt, synthetic construct
  source 1..296: mol_type = other RNA
cgctcttccgcgtctcaagagggacatctcgcgatttcttgagtctaaccccgtgatgattgacgccaaaaccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44434 - RNA, 296 nt, synthetic construct
  source 1..296: mol_type = other RNA
cgctcttccgcgtctcaagagggacatctcgcgatttcttgagtctaaccccgtgatgattgacgccaaagaaacctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44435 - RNA, 296 nt, synthetic construct
  source 1..296: mol_type = other RNA
cgctcttccgcgtctcaagagggacatctcgcgatttcttgagtctaaccccgtgatgattgacgccaaagaagtgaccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44436 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctaccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44437 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctacccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44438 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaaccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44439 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44440 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggacccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44441 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccacctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44442 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtaccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44443 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacacctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44444 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcaccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44445 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggaccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44446 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtacccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44447 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacacccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44448 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttaccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44449 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44450 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44451 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44452 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacacccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44453 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggaccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44454 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctaccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44455 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgacctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44456 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaaccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44457 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccaccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44458 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44459 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44460 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44461 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44462 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagaccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44463 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgaccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44464 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagacccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44465 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgaccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44466 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaacctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44467 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagaccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44468 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtaccgagcacggcagaatagccaagttcagcaaagtgaggaccattaccaccaggtcaaactctataaagcagggcaaagaccagcatttccccgtcttcatgaacgagacgtcggaagagc

SEQ ID NO: 44469 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgacccacggcagaatagccaagttcagcaaagtgaggaccattaccaccaggtcaaactctataaagcagggcaaagaccagcatttccccgtcttcatgaacgagacgtcggaagagc

SEQ ID NO: 44470 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagaccggcagaatagccaagttcagcaaagtgaggaccattaccaccaggtcaaactctataaagcagggcaaagaccagcatttccccgtcttcatgaacgagacgtcggaagagc

SEQ ID NO: 44471 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaccagaatagccaagttcagcaaagtgaggaccattaccaccaggtcaaactctataaagcagggcaaagaccagcatttccccgtcttcatgaacgagacgtcggaagagc

SEQ ID NO: 44472 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaccatagccaagttcagcaaagtgaggaccattaccaccaggtcaaactctataaagcagggcaaagaccagcatttccccgtcttcatgaacgagacgtcggaagagc

SEQ ID NO: 44473 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaaccgccaagttcagcaaagtgaggaccattaccaccaggtcaaactctataaagcagggcaaagaccagcatttccccgtcttcatgaacgagacgtcggaagagc

SEQ ID NO: 44474 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaccaagttcagcaaagtgaggaccattaccaccaggtcaaactctataaagcagggcaaagaccagcatttccccgtcttcatgaacgagacgtcggaagagc

SEQ ID NO: 44475 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaccttcagcaaagtgaggaccattaccaccaggtcaaactctataaagcagggcaaagaccagcatttccccgtcttcatgaacgagacgtcggaagagc

SEQ ID NO: 44476 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaccagcaaagtgaggaccattaccaccaggtcaaactctataaagcagggcaaagaccagcatttccccgtcttcatgaacgagacgtcggaagagc

SEQ ID NO: 44477 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaccaaagtgaggaccattaccaccaggtcaaactctataaagcagggcaaagaccagcatttccccgtcttcatgaacgagacgtcggaagagc

SEQ ID NO: 44478 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaccgtgaggaccattaccaccaggtcaaactctataaagcagggcaaagaccagcatttccccgtcttcatgaacgagacgtcggaagagc

SEQ ID NO: 44479 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaccaggaccattaccaccaggtcaaactctataaagcagggcaaagaccagcatttccccgtcttcatgaacgagacgtcggaagagc

SEQ ID NO: 44480 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaccaccattaccaccaggtcaaactctataaagcagggcaaagaccagcatttccccgtcttcatgaacgagacgtcggaagagc

SEQ ID NO: 44481 - RNA, 296 nt, synthetic construct; identical to SEQ ID NO: 43873
  source 1..296: mol_type = other RNA

SEQ ID NO: 44482 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaccaccaccaggtcaaactctataaagcagggcaaagaccagcatttccccgtcttcatgaacgagacgtcggaagagc

SEQ ID NO: 44483 - RNA, 296 nt, synthetic construct; identical to SEQ ID NO: 43873
  source 1..296: mol_type = other RNA

SEQ ID NO: 44484 - RNA, 296 nt, synthetic construct; identical to SEQ ID NO: 43873
  source 1..296: mol_type = other RNA

SEQ ID NO: 44485 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccacctcaaactctataaagcagggcaaagaccagcatttccccgtcttcatgaacgagacgtcggaagagc

SEQ ID NO: 44486 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaccaactctataaagcagggcaaagaccagcatttccccgtcttcatgaacgagacgtcggaagagc

SEQ ID NO: 44487 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaacctctataaagcagggcaaagaccagcatttccccgtcttcatgaacgagacgtcggaagagc

SEQ ID NO: 44488 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacaccataaagcagggcaaagaccagcatttccccgtcttcatgaacgagacgtcggaagagc

SEQ ID NO: 44489 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaccaagcagggcaaagaccagcatttccccgtcttcatgaacgagacgtcggaagagc

SEQ ID NO: 44490 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataacccagggcaaagaccagcatttccccgtcttcatgaacgagacgtcggaagagc

SEQ ID NO: 44491 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagaccggcaaagaccagcatttccccgtcttcatgaacgagacgtcggaagagc

SEQ ID NO: 44492 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaccaaagaccagcatttccccgtcttcatgaacgagacgtcggaagagc

SEQ ID NO: 44493 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaccgaccagcatttccccgtcttcatgaacgagacgtcggaagagc

SEQ ID NO: 44494 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaacccagcatttccccgtcttcatgaacgagacgtcggaagagc

SEQ ID NO: 44495 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacacccatttccccgtcttcatgaacgagacgtcggaagagc

SEQ ID NO: 44496 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagaccttccccgtcttcatgaacgagacgtcggaagagc

SEQ ID NO: 44497 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatacccccgtcttcatgaacgagacgtcggaagagc

SEQ ID NO: 44498 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcaccgtcttcatgaacgagacgtcggaagagc

SEQ ID NO: 44499 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccaccttcatgaacgagacgtcggaagagc

SEQ ID NO: 44500 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaccatgaacgagacgtcggaagagc

SEQ ID NO: 44501 - RNA, 296 nt, synthetic construct
  source 1..296: mol_type = other RNA
cgctcttccgcgtctcaagaggtagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44502 - RNA, 296 nt, synthetic construct
  source 1..296: mol_type = other RNA
cgctcttccgcgtctcaagagggactagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44503 - RNA, 296 nt, synthetic construct
  source 1..296: mol_type = other RNA
cgctcttccgcgtctcaagagggacatctagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44504 - RNA, 296 nt, synthetic construct
  source 1..296: mol_type = other RNA
cgctcttccgcgtctcaagagggacatctcgtagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44505 - RNA, 296 nt, synthetic construct
  source 1..296: mol_type = other RNA
cgctcttccgcgtctcaagagggacatctcgcgatagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44506 - RNA, 296 nt, synthetic construct
  source 1..296: mol_type = other RNA
cgctcttccgcgtctcaagagggacatctcgcgattttaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44507 - RNA, 296 nt, synthetic construct
  source 1..296: mol_type = other RNA
cgctcttccgcgtctcaagagggacatctcgcgatttctttagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44508 - RNA, 296 nt, synthetic construct
  source 1..296: mol_type = other RNA
cgctcttccgcgtctcaagagggacatctcgcgatttcttgagtagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44509 - RNA, 296 nt, synthetic construct
  source 1..296: mol_type = other RNA
cgctcttccgcgtctcaagagggacatctcgcgatttcttgagtcttagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44510 - RNA, 296 nt, synthetic construct
  source 1..296: mol_type = other RNA
cgctcttccgcgtctcaagagggacatctcgcgatttcttgagtctaactaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44511 - RNA, 296 nt, synthetic construct
  source 1..296: mol_type = other RNA
cgctcttccgcgtctcaagagggacatctcgcgatttcttgagtctaacccctagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44512 - RNA, 296 nt, synthetic construct
  source 1..296: mol_type = other RNA
cgctcttccgcgtctcaagagggacatctcgcgatttcttgagtctaaccccgtgtagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44513 - RNA, 296 nt, synthetic construct
  source 1..296: mol_type = other RNA
cgctcttccgcgtctcaagagggacatctcgcgatttcttgagtctaaccccgtgatgtaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44514 - RNA, 296 nt, synthetic construct
  source 1..296: mol_type = other RNA
cgctcttccgcgtctcaagagggacatctcgcgatttcttgagtctaaccccgtgatgatttaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44515 - RNA, 296 nt, synthetic construct
  source 1..296: mol_type = other RNA
cgctcttccgcgtctcaagagggacatctcgcgatttcttgagtctaaccccgtgatgattgactagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44516 - RNA, 296 nt, synthetic construct
  source 1..296: mol_type = other RNA
cgctcttccgcgtctcaagagggacatctcgcgatttcttgagtctaaccccgtgatgattgacgcctaggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44517 - RNA, 296 nt, synthetic construct
  source 1..296: mol_type = other RNA
cgctcttccgcgtctcaagagggacatctcgcgatttcttgagtctaaccccgtgatgattgacgccaaataggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44518 - RNA, 296 nt, synthetic construct
  source 1..296: mol_type = other RNA
cgctcttccgcgtctcaagagggacatctcgcgatttcttgagtctaaccccgtgatgattgacgccaaagaatagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44519 - RNA, 296 nt, synthetic construct
  source 1..296: mol_type = other RNA
cgctcttccgcgtctcaagagggacatctcgcgatttcttgagtctaaccccgtgatgattgacgccaaagaagtgtaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44520 - RNA, 296 nt, synthetic construct
  source 1..296: mol_type = other RNA
cgctcttccgcgtctcaagagggacatctcgcgatttcttgagtctaaccccgtgatgattgacgccaaagaagtgtcttaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44521 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgcttagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44522 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcatagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44523 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacactaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44524 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggtagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44525 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcctagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44526 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44527 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttactagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44528 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44529 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggtagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44530 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggttagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44531 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaactagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44532 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctttagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44533 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttccttagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44534 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44535 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44536 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44537 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44538 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44539 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44540 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44541 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44542 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44543 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44544 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44545 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44546 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44547 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44548 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44549 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtaggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44550 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44551 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44552 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttaggagcacggcagaatagccaagttcagcaaagtgaggaccattaccaccaggtcaaactctataaagcagggcaaagaccagcatttccccgtcttcatgaacgagacgtcggaagagc

SEQ ID NO: 44553 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtagcacggcagaatagccaagttcagcaaagtgaggaccattaccaccaggtcaaactctataaagcagggcaaagaccagcatttccccgtcttcatgaacgagacgtcggaagagc

SEQ ID NO: 44554 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtagggcagaatagccaagttcagcaaagtgaggaccattaccaccaggtcaaactctataaagcagggcaaagaccagcatttccccgtcttcatgaacgagacgtcggaagagc

SEQ ID NO: 44555 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactagagaatagccaagttcagcaaagtgaggaccattaccaccaggtcaaactctataaagcagggcaaagaccagcatttccccgtcttcatgaacgagacgtcggaagagc

SEQ ID NO: 44556 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctagatagccaagttcagcaaagtgaggaccattaccaccaggtcaaactctataaagcagggcaaagaccagcatttccccgtcttcatgaacgagacgtcggaagagc

SEQ ID NO: 44557 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagataggccaagttcagcaaagtgaggaccattaccaccaggtcaaactctataaagcagggcaaagaccagcatttccccgtcttcatgaacgagacgtcggaagagc

SEQ ID NO: 44558 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatagaagttcagcaaagtgaggaccattaccaccaggtcaaactctataaagcagggcaaagaccagcatttccccgtcttcatgaacgagacgtcggaagagc

SEQ ID NO: 44559 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctagttcagcaaagtgaggaccattaccaccaggtcaaactctataaagcagggcaaagaccagcatttccccgtcttcatgaacgagacgtcggaagagc

SEQ ID NO: 44560 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtagagcaaagtgaggaccattaccaccaggtcaaactctataaagcagggcaaagaccagcatttccccgtcttcatgaacgagacgtcggaagagc

SEQ ID NO: 44561 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctagaaagtgaggaccattaccaccaggtcaaactctataaagcagggcaaagaccagcatttccccgtcttcatgaacgagacgtcggaagagc

SEQ ID NO: 44562 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctaggtgaggaccattaccaccaggtcaaactctataaagcagggcaaagaccagcatttccccgtcttcatgaacgagacgtcggaagagc

SEQ ID NO: 44563 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatagaggaccattaccaccaggtcaaactctataaagcagggcaaagaccagcatttccccgtcttcatgaacgagacgtcggaagagc

SEQ ID NO: 44564 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtagaccattaccaccaggtcaaactctataaagcagggcaaagaccagcatttccccgtcttcatgaacgagacgtcggaagagc

SEQ ID NO: 44565 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtagattaccaccaggtcaaactctataaagcagggcaaagaccagcatttccccgtcttcatgaacgagacgtcggaagagc

SEQ ID NO: 44566 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctagaccaccaggtcaaactctataaagcagggcaaagaccagcatttccccgtcttcatgaacgagacgtcggaagagc

SEQ ID NO: 44567 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttagaccaggtcaaactctataaagcagggcaaagaccagcatttccccgtcttcatgaacgagacgtcggaagagc

SEQ ID NO: 44568 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctagaggtcaaactctataaagcagggcaaagaccagcatttccccgtcttcatgaacgagacgtcggaagagc

SEQ ID NO: 44569 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctagtcaaactctataaagcagggcaaagaccagcatttccccgtcttcatgaacgagacgtcggaagagc

SEQ ID NO: 44570 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtagaactctataaagcagggcaaagaccagcatttccccgtcttcatgaacgagacgtcggaagagc

SEQ ID NO: 44571 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatagtctataaagcagggcaaagaccagcatttccccgtcttcatgaacgagacgtcggaagagc

SEQ ID NO: 44572 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactagataaagcagggcaaagaccagcatttccccgtcttcatgaacgagacgtcggaagagc

SEQ ID NO: 44573 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttagaagcagggcaaagaccagcatttccccgtcttcatgaacgagacgtcggaagagc

SEQ ID NO: 44574 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatagcagggcaaagaccagcatttccccgtcttcatgaacgagacgtcggaagagc

SEQ ID NO: 44575 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtagggcaaagaccagcatttccccgtcttcatgaacgagacgtcggaagagc

SEQ ID NO: 44576 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtagaaagaccagcatttccccgtcttcatgaacgagacgtcggaagagc

SEQ ID NO: 44577 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctaggaccagcatttccccgtcttcatgaacgagacgtcggaagagc

SEQ ID NO: 44578 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatagcagcatttccccgtcttcatgaacgagacgtcggaagagc

SEQ ID NO: 44579 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactagcatttccccgtcttcatgaacgagacgtcggaagagc

SEQ ID NO: 44580 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtagttccccgtcttcatgaacgagacgtcggaagagc

SEQ ID NO: 44581 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattagcccgtcttcatgaacgagacgtcggaagagc

SEQ ID NO: 44582 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctaggtcttcatgaacgagacgtcggaagagc

SEQ ID NO: 44583 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctagttcatgaacgagacgtcggaagagc

SEQ ID NO: 44584 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctagatgaacgagacgtcggaagagc

SEQ ID NO: 44585 - RNA, 296 nt, synthetic construct
  source 1..296: mol_type = other RNA
cgctcttccgcgtctcaagaggtacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44586 - RNA, 296 nt, synthetic construct
  source 1..296: mol_type = other RNA
cgctcttccgcgtctcaagagggactactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44587 - RNA, 296 nt, synthetic construct
  source 1..296: mol_type = other RNA
cgctcttccgcgtctcaagagggacatctaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44588 - RNA, 296 nt, synthetic construct
  source 1..296: mol_type = other RNA
cgctcttccgcgtctcaagagggacatctcgtactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44589 - RNA, 296 nt, synthetic construct
  source 1..296: mol_type = other RNA
cgctcttccgcgtctcaagagggacatctcgcgataccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44590 - RNA, 296 nt, synthetic construct
  source 1..296: mol_type = other RNA
cgctcttccgcgtctcaagagggacatctcgcgattttacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44591 - RNA, 296 nt, synthetic construct
  source 1..296: mol_type = other RNA
cgctcttccgcgtctcaagagggacatctcgcgatttctttactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44592 - RNA, 296 nt, synthetic construct
  source 1..296: mol_type = other RNA
cgctcttccgcgtctcaagagggacatctcgcgatttcttgagtacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44593 - RNA, 296 nt, synthetic construct
  source 1..296: mol_type = other RNA
cgctcttccgcgtctcaagagggacatctcgcgatttcttgagtcttaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44594 - RNA, 296 nt, synthetic construct
  source 1..296: mol_type = other RNA
cgctcttccgcgtctcaagagggacatctcgcgatttcttgagtctaactacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44595 - RNA, 296 nt, synthetic construct
  source 1..296: mol_type = other RNA
cgctcttccgcgtctcaagagggacatctcgcgatttcttgagtctaacccctacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44596 - RNA, 296 nt, synthetic construct
  source 1..296: mol_type = other RNA
cgctcttccgcgtctcaagagggacatctcgcgatttcttgagtctaaccccgtgtacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44597 - RNA, 296 nt, synthetic construct
  source 1..296: mol_type = other RNA
cgctcttccgcgtctcaagagggacatctcgcgatttcttgagtctaaccccgtgatgtacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44598 - RNA, 296 nt, synthetic construct
  source 1..296: mol_type = other RNA
cgctcttccgcgtctcaagagggacatctcgcgatttcttgagtctaaccccgtgatgatttacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44599 - RNA, 296 nt, synthetic construct
  source 1..296: mol_type = other RNA
cgctcttccgcgtctcaagagggacatctcgcgatttcttgagtctaaccccgtgatgattgactacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44600 - RNA, 296 nt, synthetic construct
  source 1..296: mol_type = other RNA
cgctcttccgcgtctcaagagggacatctcgcgatttcttgagtctaaccccgtgatgattgacgcctacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44601 - RNA, 296 nt, synthetic construct
  source 1..296: mol_type = other RNA
cgctcttccgcgtctcaagagggacatctcgcgatttcttgagtctaaccccgtgatgattgacgccaaatacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44602 - RNA, 296 nt, synthetic construct
  source 1..296: mol_type = other RNA
cgctcttccgcgtctcaagagggacatctcgcgatttcttgagtctaaccccgtgatgattgacgccaaagaatactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44603 - RNA, 296 nt, synthetic construct
  source 1..296: mol_type = other RNA
cgctcttccgcgtctcaagagggacatctcgcgatttcttgagtctaaccccgtgatgattgacgccaaagaagtgtacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44604 - RNA, 296 nt, synthetic construct
  source 1..296: mol_type = other RNA
cgctcttccgcgtctcaagagggacatctcgcgatttcttgagtctaaccccgtgatgattgacgccaaagaagtgtcttacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44605 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgcttaccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44606 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcatacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44607 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacactacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44608 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggtaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44609 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcctactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44610 - RNA, 296 nt, synthetic construct; identical to SEQ ID NO: 43873
  source 1..296: mol_type = other RNA

SEQ ID NO: 44611 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttactactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44612 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44613 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggtacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44614 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggttaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44615 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaactaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44616 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctttacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44617 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttccttacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44618 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44619 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44620 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44621 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44622 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44623 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44624 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44625 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44626 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44627 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44628 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44629 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44630 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44631 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44632 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44633 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44634 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44635 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44636 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttacgagcacggcagaatagccaagttcagcaaagtgaggaccattaccaccaggtcaaactctataaagcagggcaaagaccagcatttccccgtcttcatgaacgagacgtcggaagagc

SEQ ID NO: 44637 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtaccacggcagaatagccaagttcagcaaagtgaggaccattaccaccaggtcaaactctataaagcagggcaaagaccagcatttccccgtcttcatgaacgagacgtcggaagagc

SEQ ID NO: 44638 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtacggcagaatagccaagttcagcaaagtgaggaccattaccaccaggtcaaactctataaagcagggcaaagaccagcatttccccgtcttcatgaacgagacgtcggaagagc

SEQ ID NO: 44639 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactacagaatagccaagttcagcaaagtgaggaccattaccaccaggtcaaactctataaagcagggcaaagaccagcatttccccgtcttcatgaacgagacgtcggaagagc

SEQ ID NO: 44640 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctacatagccaagttcagcaaagtgaggaccattaccaccaggtcaaactctataaagcagggcaaagaccagcatttccccgtcttcatgaacgagacgtcggaagagc

SEQ ID NO: 44641 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatacgccaagttcagcaaagtgaggaccattaccaccaggtcaaactctataaagcagggcaaagaccagcatttccccgtcttcatgaacgagacgtcggaagagc

SEQ ID NO: 44642 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatacaagttcagcaaagtgaggaccattaccaccaggtcaaactctataaagcagggcaaagaccagcatttccccgtcttcatgaacgagacgtcggaagagc

SEQ ID NO: 44643 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctacttcagcaaagtgaggaccattaccaccaggtcaaactctataaagcagggcaaagaccagcatttccccgtcttcatgaacgagacgtcggaagagc

SEQ ID NO: 44644 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtacagcaaagtgaggaccattaccaccaggtcaaactctataaagcagggcaaagaccagcatttccccgtcttcatgaacgagacgtcggaagagc

SEQ ID NO: 44645 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctacaaagtgaggaccattaccaccaggtcaaactctataaagcagggcaaagaccagcatttccccgtcttcatgaacgagacgtcggaagagc

SEQ ID NO: 44646 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctacgtgaggaccattaccaccaggtcaaactctataaagcagggcaaagaccagcatttccccgtcttcatgaacgagacgtcggaagagc

SEQ ID NO: 44647 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatacaggaccattaccaccaggtcaaactctataaagcagggcaaagaccagcatttccccgtcttcatgaacgagacgtcggaagagc

SEQ ID NO: 44648 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtacaccattaccaccaggtcaaactctataaagcagggcaaagaccagcatttccccgtcttcatgaacgagacgtcggaagagc

SEQ ID NO: 44649 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtacattaccaccaggtcaaactctataaagcagggcaaagaccagcatttccccgtcttcatgaacgagacgtcggaagagc

SEQ ID NO: 44650 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctacaccaccaggtcaaactctataaagcagggcaaagaccagcatttccccgtcttcatgaacgagacgtcggaagagc

SEQ ID NO: 44651 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttacaccaggtcaaactctataaagcagggcaaagaccagcatttccccgtcttcatgaacgagacgtcggaagagc

SEQ ID NO: 44652 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctacaggtcaaactctataaagcagggcaaagaccagcatttccccgtcttcatgaacgagacgtcggaagagc

SEQ ID NO: 44653 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctactcaaactctataaagcagggcaaagaccagcatttccccgtcttcatgaacgagacgtcggaagagc

SEQ ID NO: 44654 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtacaactctataaagcagggcaaagaccagcatttccccgtcttcatgaacgagacgtcggaagagc

SEQ ID NO: 44655 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatactctataaagcagggcaaagaccagcatttccccgtcttcatgaacgagacgtcggaagagc

SEQ ID NO: 44656 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactacataaagcagggcaaagaccagcatttccccgtcttcatgaacgagacgtcggaagagc

SEQ ID NO: 44657 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttacaagcagggcaaagaccagcatttccccgtcttcatgaacgagacgtcggaagagc

SEQ ID NO: 44658 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatataccagggcaaagaccagcatttccccgtcttcatgaacgagacgtcggaagagc

SEQ ID NO: 44659 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtacggcaaagaccagcatttccccgtcttcatgaacgagacgtcggaagagc

SEQ ID NO: 44660 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtacaaagaccagcatttccccgtcttcatgaacgagacgtcggaagagc

SEQ ID NO: 44661 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctacgaccagcatttccccgtcttcatgaacgagacgtcggaagagc

SEQ ID NO: 44662 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaataccagcatttccccgtcttcatgaacgagacgtcggaagagc

SEQ ID NO: 44663 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactaccatttccccgtcttcatgaacgagacgtcggaagagc

SEQ ID NO: 44664 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtacttccccgtcttcatgaacgagacgtcggaagagc

SEQ ID NO: 44665 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattaccccgtcttcatgaacgagacgtcggaagagc

SEQ ID NO: 44666 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctacgtcttcatgaacgagacgtcggaagagc

SEQ ID NO: 44667 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctacttcatgaacgagacgtcggaagagc

SEQ ID NO: 44668 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctacatgaacgagacgtcggaagagc

SEQ ID NO: 44669 - RNA, 296 nt, synthetic construct
  source 1..296: mol_type = other RNA
cgctcttccgcgtctcaagaggttgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44670 - RNA, 296 nt, synthetic construct
  source 1..296: mol_type = other RNA
cgctcttccgcgtctcaagagggacttgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44671 - RNA, 296 nt, synthetic construct
  source 1..296: mol_type = other RNA
cgctcttccgcgtctcaagagggacatcttgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44672 - RNA, 296 nt, synthetic construct
  source 1..296: mol_type = other RNA
cgctcttccgcgtctcaagagggacatctcgttgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44673 - RNA, 296 nt, synthetic construct
  source 1..296: mol_type = other RNA
cgctcttccgcgtctcaagagggacatctcgcgattgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44674 - RNA, 296 nt, synthetic construct
  source 1..296: mol_type = other RNA
cgctcttccgcgtctcaagagggacatctcgcgatttttggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44675 - RNA, 296 nt, synthetic construct
  source 1..296: mol_type = other RNA
cgctcttccgcgtctcaagagggacatctcgcgatttcttttgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44676 - RNA, 296 nt, synthetic construct
  source 1..296: mol_type = other RNA
cgctcttccgcgtctcaagagggacatctcgcgatttcttgagttgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44677 - RNA, 296 nt, synthetic construct
  source 1..296: mol_type = other RNA
cgctcttccgcgtctcaagagggacatctcgcgatttcttgagtctttgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44678 - RNA, 296 nt, synthetic construct
  source 1..296: mol_type = other RNA
cgctcttccgcgtctcaagagggacatctcgcgatttcttgagtctaacttggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44679 - RNA, 296 nt, synthetic construct
  source 1..296: mol_type = other RNA
cgctcttccgcgtctcaagagggacatctcgcgatttcttgagtctaaccccttgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44680 - RNA, 296 nt, synthetic construct
  source 1..296: mol_type = other RNA
cgctcttccgcgtctcaagagggacatctcgcgatttcttgagtctaaccccgtgttgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44681 - RNA, 296 nt, synthetic construct
  source 1..296: mol_type = other RNA
cgctcttccgcgtctcaagagggacatctcgcgatttcttgagtctaaccccgtgatgttggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44682 - RNA, 296 nt, synthetic construct
  source 1..296: mol_type = other RNA
cgctcttccgcgtctcaagagggacatctcgcgatttcttgagtctaaccccgtgatgattttggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44683 - RNA, 296 nt, synthetic construct
  source 1..296: mol_type = other RNA
cgctcttccgcgtctcaagagggacatctcgcgatttcttgagtctaaccccgtgatgattgacttgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44684 - RNA, 296 nt, synthetic construct
  source 1..296: mol_type = other RNA
cgctcttccgcgtctcaagagggacatctcgcgatttcttgagtctaaccccgtgatgattgacgccttggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44685 - RNA, 296 nt, synthetic construct
  source 1..296: mol_type = other RNA
cgctcttccgcgtctcaagagggacatctcgcgatttcttgagtctaaccccgtgatgattgacgccaaattggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44686 - RNA, 296 nt, synthetic construct
  source 1..296: mol_type = other RNA
cgctcttccgcgtctcaagagggacatctcgcgatttcttgagtctaaccccgtgatgattgacgccaaagaattgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44687 - RNA, 296 nt, synthetic construct
  source 1..296: mol_type = other RNA
cgctcttccgcgtctcaagagggacatctcgcgatttcttgagtctaaccccgtgatgattgacgccaaagaagtgttggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44688 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctttggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44689 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctttgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44690 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcattgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44691 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacttggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44692 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggttgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44693 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccttgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44694 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtttgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44695 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44696 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcttgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44697 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggttgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44698 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtttgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44699 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacttgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44700 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttttgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44701 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctttgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44702 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcttgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44703 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgttgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44704 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacttgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44705 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggttgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44706 - RNA, 296 nt, synthetic construct; identical to SEQ ID NO: 43873
  source 1..296: mol_type = other RNA

SEQ ID NO: 44707 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgttgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44708 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcattgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44709 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccttggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44710 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactttgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44711 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgttggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44712 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatttgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44713 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatttgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44714 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagttggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44715 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgttgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44716 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagttgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44717 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgttggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44718 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaattgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44719 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagttgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44720 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtttggagcacggcagaatagccaagttcagcaaagtgaggaccattaccaccaggtcaaactctataaagcagggcaaagaccagcatttccccgtcttcatgaacgagacgtcggaagagc

SEQ ID NO: 44721 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgttgcacggcagaatagccaagttcagcaaagtgaggaccattaccaccaggtcaaactctataaagcagggcaaagaccagcatttccccgtcttcatgaacgagacgtcggaagagc

SEQ ID NO: 44722 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagttgggcagaatagccaagttcagcaaagtgaggaccattaccaccaggtcaaactctataaagcagggcaaagaccagcatttccccgtcttcatgaacgagacgtcggaagagc

SEQ ID NO: 44723 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacttgagaatagccaagttcagcaaagtgaggaccattaccaccaggtcaaactctataaagcagggcaaagaccagcatttccccgtcttcatgaacgagacgtcggaagagc

SEQ ID NO: 44724 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcttgatagccaagttcagcaaagtgaggaccattaccaccaggtcaaactctataaagcagggcaaagaccagcatttccccgtcttcatgaacgagacgtcggaagagc

SEQ ID NO: 44725 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagattggccaagttcagcaaagtgaggaccattaccaccaggtcaaactctataaagcagggcaaagaccagcatttccccgtcttcatgaacgagacgtcggaagagc

SEQ ID NO: 44726 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatattgaagttcagcaaagtgaggaccattaccaccaggtcaaactctataaagcagggcaaagaccagcatttccccgtcttcatgaacgagacgtcggaagagc

SEQ ID NO: 44727 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccttgttcagcaaagtgaggaccattaccaccaggtcaaactctataaagcagggcaaagaccagcatttccccgtcttcatgaacgagacgtcggaagagc

SEQ ID NO: 44728 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttgagcaaagtgaggaccattaccaccaggtcaaactctataaagcagggcaaagaccagcatttccccgtcttcatgaacgagacgtcggaagagc

SEQ ID NO: 44729 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcttgaaagtgaggaccattaccaccaggtcaaactctataaagcagggcaaagaccagcatttccccgtcttcatgaacgagacgtcggaagagc

SEQ ID NO: 44730 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcttggtgaggaccattaccaccaggtcaaactctataaagcagggcaaagaccagcatttccccgtcttcatgaacgagacgtcggaagagc

SEQ ID NO: 44731 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaattgaggaccattaccaccaggtcaaactctataaagcagggcaaagaccagcatttccccgtcttcatgaacgagacgtcggaagagc

SEQ ID NO: 44732 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgttgaccattaccaccaggtcaaactctataaagcagggcaaagaccagcatttccccgtcttcatgaacgagacgtcggaagagc

SEQ ID NO: 44733 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggttgattaccaccaggtcaaactctataaagcagggcaaagaccagcatttccccgtcttcatgaacgagacgtcggaagagc

SEQ ID NO: 44734 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccttgaccaccaggtcaaactctataaagcagggcaaagaccagcatttccccgtcttcatgaacgagacgtcggaagagc

SEQ ID NO: 44735 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattttgaccaggtcaaactctataaagcagggcaaagaccagcatttccccgtcttcatgaacgagacgtcggaagagc

SEQ ID NO: 44736 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccttgaggtcaaactctataaagcagggcaaagaccagcatttccccgtcttcatgaacgagacgtcggaagagc

SEQ ID NO: 44737 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccttgtcaaactctataaagcagggcaaagaccagcatttccccgtcttcatgaacgagacgtcggaagagc

SEQ ID NO: 44738 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggttgaactctataaagcagggcaaagaccagcatttccccgtcttcatgaacgagacgtcggaagagc

SEQ ID NO: 44739 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcattgtctataaagcagggcaaagaccagcatttccccgtcttcatgaacgagacgtcggaagagc

SEQ ID NO: 44740 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacttgataaagcagggcaaagaccagcatttccccgtcttcatgaacgagacgtcggaagagc

SEQ ID NO: 44741 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctttgaagcagggcaaagaccagcatttccccgtcttcatgaacgagacgtcggaagagc

SEQ ID NO: 44742 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatattgcagggcaaagaccagcatttccccgtcttcatgaacgagacgtcggaagagc

SEQ ID NO: 44743 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagttgggcaaagaccagcatttccccgtcttcatgaacgagacgtcggaagagc

SEQ ID NO: 44744 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagttgaaagaccagcatttccccgtcttcatgaacgagacgtcggaagagc

SEQ ID NO: 44745 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcttggaccagcatttccccgtcttcatgaacgagacgtcggaagagc

SEQ ID NO: 44746 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaattgcagcatttccccgtcttcatgaacgagacgtcggaagagc

SEQ ID NO: 44747 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacttgcatttccccgtcttcatgaacgagacgtcggaagagc

SEQ ID NO: 44748 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagttgttccccgtcttcatgaacgagacgtcggaagagc

SEQ ID NO: 44749 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttgcccgtcttcatgaacgagacgtcggaagagc

SEQ ID NO: 44750 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcttggtcttcatgaacgagacgtcggaagagc

SEQ ID NO: 44751 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccttgttcatgaacgagacgtcggaagagc

SEQ ID NO: 44752 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttgatgaacgagacgtcggaagagc

SEQ ID NO: 44753 - RNA, 296 nt, synthetic construct
  source 1..296: mol_type = other RNA
cgctcttccgcgtctcaagaggttcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44754 - RNA, 296 nt, synthetic construct
  source 1..296: mol_type = other RNA
cgctcttccgcgtctcaagagggacttctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44755 - RNA, 296 nt, synthetic construct
  source 1..296: mol_type = other RNA
cgctcttccgcgtctcaagagggacatcttccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44756 - RNA, 296 nt, synthetic construct
  source 1..296: mol_type = other RNA
cgctcttccgcgtctcaagagggacatctcgttctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44757 - RNA, 296 nt, synthetic construct
  source 1..296: mol_type = other RNA
cgctcttccgcgtctcaagagggacatctcgcgattccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44758 - RNA, 296 nt, synthetic construct
  source 1..296: mol_type = other RNA
cgctcttccgcgtctcaagagggacatctcgcgatttttcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44759 - RNA, 296 nt, synthetic construct
  source 1..296: mol_type = other RNA
cgctcttccgcgtctcaagagggacatctcgcgatttcttttctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44760 - RNA, 296 nt, synthetic construct
  source 1..296: mol_type = other RNA
cgctcttccgcgtctcaagagggacatctcgcgatttcttgagttcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44761 - RNA, 296 nt, synthetic construct
  source 1..296: mol_type = other RNA
cgctcttccgcgtctcaagagggacatctcgcgatttcttgagtctttccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44762 - RNA, 296 nt, synthetic construct
  source 1..296: mol_type = other RNA
cgctcttccgcgtctcaagagggacatctcgcgatttcttgagtctaacttcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44763 - RNA, 296 nt, synthetic construct
  source 1..296: mol_type = other RNA
cgctcttccgcgtctcaagagggacatctcgcgatttcttgagtctaaccccttcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44764 - RNA, 296 nt, synthetic construct
  source 1..296: mol_type = other RNA
cgctcttccgcgtctcaagagggacatctcgcgatttcttgagtctaaccccgtgttcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44765 - RNA, 296 nt, synthetic construct
  source 1..296: mol_type = other RNA
cgctcttccgcgtctcaagagggacatctcgcgatttcttgagtctaaccccgtgatgttcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44766 - RNA, 296 nt, synthetic construct
  source 1..296: mol_type = other RNA
cgctcttccgcgtctcaagagggacatctcgcgatttcttgagtctaaccccgtgatgattttcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44767 - RNA, 296 nt, synthetic construct
  source 1..296: mol_type = other RNA
cgctcttccgcgtctcaagagggacatctcgcgatttcttgagtctaaccccgtgatgattgacttcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44768 - RNA, 296 nt, synthetic construct
  source 1..296: mol_type = other RNA
cgctcttccgcgtctcaagagggacatctcgcgatttcttgagtctaaccccgtgatgattgacgccttcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44769 - RNA, 296 nt, synthetic construct
  source 1..296: mol_type = other RNA
cgctcttccgcgtctcaagagggacatctcgcgatttcttgagtctaaccccgtgatgattgacgccaaattcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44770 - RNA, 296 nt, synthetic construct
  source 1..296: mol_type = other RNA
cgctcttccgcgtctcaagagggacatctcgcgatttcttgagtctaaccccgtgatgattgacgccaaagaattctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44771 - RNA, 296 nt, synthetic construct
  source 1..296: mol_type = other RNA
cgctcttccgcgtctcaagagggacatctcgcgatttcttgagtctaaccccgtgatgattgacgccaaagaagtgttcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44772 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctttcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44773 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctttccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44774 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcattcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44775 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacttcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44776 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggttccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44777 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccttctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44778 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtttcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44779 - RNA, 296 nt, synthetic construct; identical to SEQ ID NO: 43873
  source 1..296: mol_type = other RNA

SEQ ID NO: 44780 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcttcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44781 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggttcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44782 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtttccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44783 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacttccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44784 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttttcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44785 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctttcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44786 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcttcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44787 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgttcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44788 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacttccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44789 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggttcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44790 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44791 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgttctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44792 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcattcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44793 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccttcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44794 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactttcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44795 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgttcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44796 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatttcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44797 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatttcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44798 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagttcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44799 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgttcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44800 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagttccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44801 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgttcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44802 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaattctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44803 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagttcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44804 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtttcgagcacggcagaatagccaagttcagcaaagtgaggaccattaccaccaggtcaaactctataaagcagggcaaagaccagcatttccccgtcttcatgaacgagacgtcggaagagc

SEQ ID NO: 44805 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgttccacggcagaatagccaagttcagcaaagtgaggaccattaccaccaggtcaaactctataaagcagggcaaagaccagcatttccccgtcttcatgaacgagacgtcggaagagc

SEQ ID NO: 44806 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagttcggcagaatagccaagttcagcaaagtgaggaccattaccaccaggtcaaactctataaagcagggcaaagaccagcatttccccgtcttcatgaacgagacgtcggaagagc

SEQ ID NO: 44807 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacttcagaatagccaagttcagcaaagtgaggaccattaccaccaggtcaaactctataaagcagggcaaagaccagcatttccccgtcttcatgaacgagacgtcggaagagc

SEQ ID NO: 44808 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcttcatagccaagttcagcaaagtgaggaccattaccaccaggtcaaactctataaagcagggcaaagaccagcatttccccgtcttcatgaacgagacgtcggaagagc

SEQ ID NO: 44809 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagattcgccaagttcagcaaagtgaggaccattaccaccaggtcaaactctataaagcagggcaaagaccagcatttccccgtcttcatgaacgagacgtcggaagagc

SEQ ID NO: 44810 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatattcaagttcagcaaagtgaggaccattaccaccaggtcaaactctataaagcagggcaaagaccagcatttccccgtcttcatgaacgagacgtcggaagagc

SEQ ID NO: 44811 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccttcttcagcaaagtgaggaccattaccaccaggtcaaactctataaagcagggcaaagaccagcatttccccgtcttcatgaacgagacgtcggaagagc

SEQ ID NO: 44812 - RNA, 296 nt, synthetic construct; identical to SEQ ID NO: 43873
  source 1..296: mol_type = other RNA

SEQ ID NO: 44813 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcttcaaagtgaggaccattaccaccaggtcaaactctataaagcagggcaaagaccagcatttccccgtcttcatgaacgagacgtcggaagagc

SEQ ID NO: 44814 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcttcgtgaggaccattaccaccaggtcaaactctataaagcagggcaaagaccagcatttccccgtcttcatgaacgagacgtcggaagagc

SEQ ID NO: 44815 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaattcaggaccattaccaccaggtcaaactctataaagcagggcaaagaccagcatttccccgtcttcatgaacgagacgtcggaagagc

SEQ ID NO: 44816 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgttcaccattaccaccaggtcaaactctataaagcagggcaaagaccagcatttccccgtcttcatgaacgagacgtcggaagagc

SEQ ID NO: 44817 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggttcattaccaccaggtcaaactctataaagcagggcaaagaccagcatttccccgtcttcatgaacgagacgtcggaagagc

SEQ ID NO: 44818 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccttcaccaccaggtcaaactctataaagcagggcaaagaccagcatttccccgtcttcatgaacgagacgtcggaagagc

SEQ ID NO: 44819 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattttcaccaggtcaaactctataaagcagggcaaagaccagcatttccccgtcttcatgaacgagacgtcggaagagc

SEQ ID NO: 44820 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccttcaggtcaaactctataaagcagggcaaagaccagcatttccccgtcttcatgaacgagacgtcggaagagc

SEQ ID NO: 44821 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccttctcaaactctataaagcagggcaaagaccagcatttccccgtcttcatgaacgagacgtcggaagagc

SEQ ID NO: 44822 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggttcaactctataaagcagggcaaagaccagcatttccccgtcttcatgaacgagacgtcggaagagc

SEQ ID NO: 44823 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcattctctataaagcagggcaaagaccagcatttccccgtcttcatgaacgagacgtcggaagagc

SEQ ID NO: 44824 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacttcataaagcagggcaaagaccagcatttccccgtcttcatgaacgagacgtcggaagagc

SEQ ID NO: 44825 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctttcaagcagggcaaagaccagcatttccccgtcttcatgaacgagacgtcggaagagc

SEQ ID NO: 44826 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatattccagggcaaagaccagcatttccccgtcttcatgaacgagacgtcggaagagc

SEQ ID NO: 44827 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagttcggcaaagaccagcatttccccgtcttcatgaacgagacgtcggaagagc

SEQ ID NO: 44828 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagttcaaagaccagcatttccccgtcttcatgaacgagacgtcggaagagc

SEQ ID NO: 44829 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcttcgaccagcatttccccgtcttcatgaacgagacgtcggaagagc

SEQ ID NO: 44830 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaattccagcatttccccgtcttcatgaacgagacgtcggaagagc

SEQ ID NO: 44831 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacttccatttccccgtcttcatgaacgagacgtcggaagagc

SEQ ID NO: 44832 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagttcttccccgtcttcatgaacgagacgtcggaagagc

SEQ ID NO: 44833 - RNA, 296 nt, synthetic construct; identical to SEQ ID NO: 43873
  source 1..296: mol_type = other RNA

SEQ ID NO: 44834 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcttcgtcttcatgaacgagacgtcggaagagc

SEQ ID NO: 44835 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccttcttcatgaacgagacgtcggaagagc

SEQ ID NO: 44836 - RNA, 296 nt, synthetic construct; identical to SEQ ID NO: 43873
  source 1..296: mol_type = other RNA

SEQ ID NO: 44837 - RNA, 296 nt, synthetic construct
  source 1..296: mol_type = other RNA
cgctcttccgcgtctcaagaggtggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44838 - RNA, 296 nt, synthetic construct
  source 1..296: mol_type = other RNA
cgctcttccgcgtctcaagagggactggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44839 - RNA, 296 nt, synthetic construct
  source 1..296: mol_type = other RNA
cgctcttccgcgtctcaagagggacatctggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44840 - RNA, 296 nt, synthetic construct
  source 1..296: mol_type = other RNA
cgctcttccgcgtctcaagagggacatctcgtggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44841 - RNA, 296 nt, synthetic construct
  source 1..296: mol_type = other RNA
cgctcttccgcgtctcaagagggacatctcgcgatggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44842 - RNA, 296 nt, synthetic construct
  source 1..296: mol_type = other RNA
cgctcttccgcgtctcaagagggacatctcgcgattttgggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44843 - RNA, 296 nt, synthetic construct
  source 1..296: mol_type = other RNA
cgctcttccgcgtctcaagagggacatctcgcgatttctttggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44844 - RNA, 296 nt, synthetic construct
  source 1..296: mol_type = other RNA
cgctcttccgcgtctcaagagggacatctcgcgatttcttgagtggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44845 - RNA, 296 nt, synthetic construct
  source 1..296: mol_type = other RNA
cgctcttccgcgtctcaagagggacatctcgcgatttcttgagtcttggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44846 - RNA, 296 nt, synthetic construct
  source 1..296: mol_type = other RNA
cgctcttccgcgtctcaagagggacatctcgcgatttcttgagtctaactgggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44847 - RNA, 296 nt, synthetic construct
  source 1..296: mol_type = other RNA
cgctcttccgcgtctcaagagggacatctcgcgatttcttgagtctaacccctggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44848 - RNA, 296 nt, synthetic construct
  source 1..296: mol_type = other RNA
cgctcttccgcgtctcaagagggacatctcgcgatttcttgagtctaaccccgtgtggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44849 - RNA, 296 nt, synthetic construct
  source 1..296: mol_type = other RNA
cgctcttccgcgtctcaagagggacatctcgcgatttcttgagtctaaccccgtgatgtgggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44850 - RNA, 296 nt, synthetic construct
  source 1..296: mol_type = other RNA
cgctcttccgcgtctcaagagggacatctcgcgatttcttgagtctaaccccgtgatgatttgggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44851 - RNA, 296 nt, synthetic construct
  source 1..296: mol_type = other RNA
cgctcttccgcgtctcaagagggacatctcgcgatttcttgagtctaaccccgtgatgattgactggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44852 - RNA, 296 nt, synthetic construct
  source 1..296: mol_type = other RNA
cgctcttccgcgtctcaagagggacatctcgcgatttcttgagtctaaccccgtgatgattgacgcctgggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44853 - RNA, 296 nt, synthetic construct
  source 1..296: mol_type = other RNA
cgctcttccgcgtctcaagagggacatctcgcgatttcttgagtctaaccccgtgatgattgacgccaaatgggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44854 - RNA, 296 nt, synthetic construct
  source 1..296: mol_type = other RNA
cgctcttccgcgtctcaagagggacatctcgcgatttcttgagtctaaccccgtgatgattgacgccaaagaatggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44855 - RNA, 296 nt, synthetic construct
  source 1..296: mol_type = other RNA
cgctcttccgcgtctcaagagggacatctcgcgatttcttgagtctaaccccgtgatgattgacgccaaagaagtgtgggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44856 - RNA, 296 nt, synthetic construct
  source 1..296: mol_type = other RNA
cgctcttccgcgtctcaagagggacatctcgcgatttcttgagtctaaccccgtgatgattgacgccaaagaagtgtcttgggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44857 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgcttggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44858 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcatggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44859 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacactgggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44860 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggtggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44861 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcctggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44862 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44863 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttactggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44864 - RNA, 296 nt, synthetic construct; identical to SEQ ID NO: 43873
  source 1..296: mol_type = other RNA

SEQ ID NO: 44865 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggtggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44866 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggttggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44867 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaactggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44868 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctttggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44869 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttccttggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44870 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44871 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44872 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44873 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44874 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttgggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44875 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44876 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44877 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctgggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44878 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44879 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtgggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44880 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44881 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44882 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtgggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44883 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44884 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44885 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtgggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44886 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44887 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44888 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttgggagcacggcagaatagccaagttcagcaaagtgaggaccattaccaccaggtcaaactctataaagcagggcaaagaccagcatttccccgtcttcatgaacgagacgtcggaagagc

SEQ ID NO: 44889 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtggcacggcagaatagccaagttcagcaaagtgaggaccattaccaccaggtcaaactctataaagcagggcaaagaccagcatttccccgtcttcatgaacgagacgtcggaagagc

SEQ ID NO: 44890 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtggggcagaatagccaagttcagcaaagtgaggaccattaccaccaggtcaaactctataaagcagggcaaagaccagcatttccccgtcttcatgaacgagacgtcggaagagc

SEQ ID NO: 44891 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactggagaatagccaagttcagcaaagtgaggaccattaccaccaggtcaaactctataaagcagggcaaagaccagcatttccccgtcttcatgaacgagacgtcggaagagc

SEQ ID NO: 44892 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctggatagccaagttcagcaaagtgaggaccattaccaccaggtcaaactctataaagcagggcaaagaccagcatttccccgtcttcatgaacgagacgtcggaagagc

SEQ ID NO: 44893 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatgggccaagttcagcaaagtgaggaccattaccaccaggtcaaactctataaagcagggcaaagaccagcatttccccgtcttcatgaacgagacgtcggaagagc

SEQ ID NO: 44894 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatggaagttcagcaaagtgaggaccattaccaccaggtcaaactctataaagcagggcaaagaccagcatttccccgtcttcatgaacgagacgtcggaagagc

SEQ ID NO: 44895 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctggttcagcaaagtgaggaccattaccaccaggtcaaactctataaagcagggcaaagaccagcatttccccgtcttcatgaacgagacgtcggaagagc

SEQ ID NO: 44896 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtggagcaaagtgaggaccattaccaccaggtcaaactctataaagcagggcaaagaccagcatttccccgtcttcatgaacgagacgtcggaagagc

SEQ ID NO: 44897 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctggaaagtgaggaccattaccaccaggtcaaactctataaagcagggcaaagaccagcatttccccgtcttcatgaacgagacgtcggaagagc

SEQ ID NO: 44898 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctgggtgaggaccattaccaccaggtcaaactctataaagcagggcaaagaccagcatttccccgtcttcatgaacgagacgtcggaagagc

SEQ ID NO: 44899 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatggaggaccattaccaccaggtcaaactctataaagcagggcaaagaccagcatttccccgtcttcatgaacgagacgtcggaagagc

SEQ ID NO: 44900 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtggaccattaccaccaggtcaaactctataaagcagggcaaagaccagcatttccccgtcttcatgaacgagacgtcggaagagc

SEQ ID NO: 44901 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtggattaccaccaggtcaaactctataaagcagggcaaagaccagcatttccccgtcttcatgaacgagacgtcggaagagc

SEQ ID NO: 44902 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctggaccaccaggtcaaactctataaagcagggcaaagaccagcatttccccgtcttcatgaacgagacgtcggaagagc

SEQ ID NO: 44903 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttggaccaggtcaaactctataaagcagggcaaagaccagcatttccccgtcttcatgaacgagacgtcggaagagc

SEQ ID NO: 44904 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctggaggtcaaactctataaagcagggcaaagaccagcatttccccgtcttcatgaacgagacgtcggaagagc

SEQ ID NO: 44905 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctggtcaaactctataaagcagggcaaagaccagcatttccccgtcttcatgaacgagacgtcggaagagc

SEQ ID NO: 44906 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtggaactctataaagcagggcaaagaccagcatttccccgtcttcatgaacgagacgtcggaagagc

SEQ ID NO: 44907 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatggtctataaagcagggcaaagaccagcatttccccgtcttcatgaacgagacgtcggaagagc

SEQ ID NO: 44908 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactggataaagcagggcaaagaccagcatttccccgtcttcatgaacgagacgtcggaagagc

SEQ ID NO: 44909 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttggaagcagggcaaagaccagcatttccccgtcttcatgaacgagacgtcggaagagc

SEQ ID NO: 44910 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatggcagggcaaagaccagcatttccccgtcttcatgaacgagacgtcggaagagc

SEQ ID NO: 44911 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtggggcaaagaccagcatttccccgtcttcatgaacgagacgtcggaagagc

SEQ ID NO: 44912 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtggaaagaccagcatttccccgtcttcatgaacgagacgtcggaagagc

SEQ ID NO: 44913 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctgggaccagcatttccccgtcttcatgaacgagacgtcggaagagc

SEQ ID NO: 44914 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatggcagcatttccccgtcttcatgaacgagacgtcggaagagc

SEQ ID NO: 44915 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactggcatttccccgtcttcatgaacgagacgtcggaagagc

SEQ ID NO: 44916 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtggttccccgtcttcatgaacgagacgtcggaagagc

SEQ ID NO: 44917 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattggcccgtcttcatgaacgagacgtcggaagagc

SEQ ID NO: 44918 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctgggtcttcatgaacgagacgtcggaagagc

SEQ ID NO: 44919 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctggttcatgaacgagacgtcggaagagc

SEQ ID NO: 44920 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctggatgaacgagacgtcggaagagc

SEQ ID NO: 44921 - RNA, 296 nt, synthetic construct
  source 1..296: mol_type = other RNA
cgctcttccgcgtctcaagaggtgcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44922 - RNA, 296 nt, synthetic construct
  source 1..296: mol_type = other RNA
cgctcttccgcgtctcaagagggactgctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44923 - RNA, 296 nt, synthetic construct
  source 1..296: mol_type = other RNA
cgctcttccgcgtctcaagagggacatctgccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44924 - RNA, 296 nt, synthetic construct
  source 1..296: mol_type = other RNA
cgctcttccgcgtctcaagagggacatctcgtgctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44925 - RNA, 296 nt, synthetic construct
  source 1..296: mol_type = other RNA
cgctcttccgcgtctcaagagggacatctcgcgatgccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44926 - RNA, 296 nt, synthetic construct
  source 1..296: mol_type = other RNA
cgctcttccgcgtctcaagagggacatctcgcgattttgcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44927 - RNA, 296 nt, synthetic construct
  source 1..296: mol_type = other RNA
cgctcttccgcgtctcaagagggacatctcgcgatttctttgctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44928 - RNA, 296 nt, synthetic construct
  source 1..296: mol_type = other RNA
cgctcttccgcgtctcaagagggacatctcgcgatttcttgagtgcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44929 - RNA, 296 nt, synthetic construct
  source 1..296: mol_type = other RNA
cgctcttccgcgtctcaagagggacatctcgcgatttcttgagtcttgccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44930 - RNA, 296 nt, synthetic construct
  source 1..296: mol_type = other RNA
cgctcttccgcgtctcaagagggacatctcgcgatttcttgagtctaactgcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44931 - RNA, 296 nt, synthetic construct
  source 1..296: mol_type = other RNA
cgctcttccgcgtctcaagagggacatctcgcgatttcttgagtctaacccctgcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44932 - RNA, 296 nt, synthetic construct
  source 1..296: mol_type = other RNA
cgctcttccgcgtctcaagagggacatctcgcgatttcttgagtctaaccccgtgtgcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44933 - RNA, 296 nt, synthetic construct
  source 1..296: mol_type = other RNA
cgctcttccgcgtctcaagagggacatctcgcgatttcttgagtctaaccccgtgatgtgcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44934 - RNA, 296 nt, synthetic construct
  source 1..296: mol_type = other RNA
cgctcttccgcgtctcaagagggacatctcgcgatttcttgagtctaaccccgtgatgatttgcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44935 - RNA, 296 nt, synthetic construct
  source 1..296: mol_type = other RNA
cgctcttccgcgtctcaagagggacatctcgcgatttcttgagtctaaccccgtgatgattgactgcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44936 - RNA, 296 nt, synthetic construct
  source 1..296: mol_type = other RNA
cgctcttccgcgtctcaagagggacatctcgcgatttcttgagtctaaccccgtgatgattgacgcctgcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44937 - RNA, 296 nt, synthetic construct
  source 1..296: mol_type = other RNA
cgctcttccgcgtctcaagagggacatctcgcgatttcttgagtctaaccccgtgatgattgacgccaaatgcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44938 - RNA, 296 nt, synthetic construct
  source 1..296: mol_type = other RNA
cgctcttccgcgtctcaagagggacatctcgcgatttcttgagtctaaccccgtgatgattgacgccaaagaatgctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44939 - RNA, 296 nt, synthetic construct
  source 1..296: mol_type = other RNA
cgctcttccgcgtctcaagagggacatctcgcgatttcttgagtctaaccccgtgatgattgacgccaaagaagtgtgcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44940 - RNA, 296 nt, synthetic construct
  source 1..296: mol_type = other RNA
cgctcttccgcgtctcaagagggacatctcgcgatttcttgagtctaaccccgtgatgattgacgccaaagaagtgtcttgcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44941 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgcttgccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44942 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcatgcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44943 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacactgcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44944 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggtgccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44945 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcctgctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44946 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttgcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44947 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttactgctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44948 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44949 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggtgcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44950 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggttgccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44951 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaactgccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44952 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctttgcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44953 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttccttgcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44954 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctgcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44955 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtgcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44956 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactgccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44957 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtgcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44958 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttgcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44959 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtgctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44960 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatgcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44961 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctgcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44962 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttgcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44963 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtgcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44964 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattgcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44965 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattgcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44966 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtgcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44967 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtgcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44968 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtgccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44969 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtgcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44970 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatgctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44971 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 44972 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttgcgagcacggcagaatagccaagttcagcaaagtgaggaccattaccaccaggtcaaactctataaagcagggcaaagaccagcatttccccgtcttcatgaacgagacgtcggaagagc

SEQ ID NO: 44973 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtgccacggcagaatagccaagttcagcaaagtgaggaccattaccaccaggtcaaactctataaagcagggcaaagaccagcatttccccgtcttcatgaacgagacgtcggaagagc

SEQ ID NO: 44974 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtgcggcagaatagccaagttcagcaaagtgaggaccattaccaccaggtcaaactctataaagcagggcaaagaccagcatttccccgtcttcatgaacgagacgtcggaagagc

SEQ ID NO: 44975 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactgcagaatagccaagttcagcaaagtgaggaccattaccaccaggtcaaactctataaagcagggcaaagaccagcatttccccgtcttcatgaacgagacgtcggaagagc

SEQ ID NO: 44976 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctgcatagccaagttcagcaaagtgaggaccattaccaccaggtcaaactctataaagcagggcaaagaccagcatttccccgtcttcatgaacgagacgtcggaagagc

SEQ ID NO: 44977 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatgcgccaagttcagcaaagtgaggaccattaccaccaggtcaaactctataaagcagggcaaagaccagcatttccccgtcttcatgaacgagacgtcggaagagc

SEQ ID NO: 44978 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatgcaagttcagcaaagtgaggaccattaccaccaggtcaaactctataaagcagggcaaagaccagcatttccccgtcttcatgaacgagacgtcggaagagc

SEQ ID NO: 44979 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctgcttcagcaaagtgaggaccattaccaccaggtcaaactctataaagcagggcaaagaccagcatttccccgtcttcatgaacgagacgtcggaagagc

SEQ ID NO: 44980 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtgcagcaaagtgaggaccattaccaccaggtcaaactctataaagcagggcaaagaccagcatttccccgtcttcatgaacgagacgtcggaagagc

SEQ ID NO: 44981 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctgcaaagtgaggaccattaccaccaggtcaaactctataaagcagggcaaagaccagcatttccccgtcttcatgaacgagacgtcggaagagc

SEQ ID NO: 44982 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctgcgtgaggaccattaccaccaggtcaaactctataaagcagggcaaagaccagcatttccccgtcttcatgaacgagacgtcggaagagc

SEQ ID NO: 44983 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatgcaggaccattaccaccaggtcaaactctataaagcagggcaaagaccagcatttccccgtcttcatgaacgagacgtcggaagagc

SEQ ID NO: 44984 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtgcaccattaccaccaggtcaaactctataaagcagggcaaagaccagcatttccccgtcttcatgaacgagacgtcggaagagc

SEQ ID NO: 44985 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtgcattaccaccaggtcaaactctataaagcagggcaaagaccagcatttccccgtcttcatgaacgagacgtcggaagagc

SEQ ID NO: 44986 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctgcaccaccaggtcaaactctataaagcagggcaaagaccagcatttccccgtcttcatgaacgagacgtcggaagagc

SEQ ID NO: 44987 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttgcaccaggtcaaactctataaagcagggcaaagaccagcatttccccgtcttcatgaacgagacgtcggaagagc

SEQ ID NO: 44988 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctgcaggtcaaactctataaagcagggcaaagaccagcatttccccgtcttcatgaacgagacgtcggaagagc

SEQ ID NO: 44989 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctgctcaaactctataaagcagggcaaagaccagcatttccccgtcttcatgaacgagacgtcggaagagc

SEQ ID NO: 44990 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtgcaactctataaagcagggcaaagaccagcatttccccgtcttcatgaacgagacgtcggaagagc

SEQ ID NO: 44991 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatgctctataaagcagggcaaagaccagcatttccccgtcttcatgaacgagacgtcggaagagc

SEQ ID NO: 44992 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactgcataaagcagggcaaagaccagcatttccccgtcttcatgaacgagacgtcggaagagc

SEQ ID NO: 44993 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttgcaagcagggcaaagaccagcatttccccgtcttcatgaacgagacgtcggaagagc

SEQ ID NO: 44994 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatgccagggcaaagaccagcatttccccgtcttcatgaacgagacgtcggaagagc

SEQ ID NO: 44995 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtgcggcaaagaccagcatttccccgtcttcatgaacgagacgtcggaagagc

SEQ ID NO: 44996 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtgcaaagaccagcatttccccgtcttcatgaacgagacgtcggaagagc

SEQ ID NO: 44997 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctgcgaccagcatttccccgtcttcatgaacgagacgtcggaagagc

SEQ ID NO: 44998 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatgccagcatttccccgtcttcatgaacgagacgtcggaagagc

SEQ ID NO: 44999 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactgccatttccccgtcttcatgaacgagacgtcggaagagc

SEQ ID NO: 45000 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtgcttccccgtcttcatgaacgagacgtcggaagagc

SEQ ID NO: 45001 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattgccccgtcttcatgaacgagacgtcggaagagc

SEQ ID NO: 45002 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctgcgtcttcatgaacgagacgtcggaagagc

SEQ ID NO: 45003 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctgcttcatgaacgagacgtcggaagagc

SEQ ID NO: 45004 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctgcatgaacgagacgtcggaagagc

SEQ ID NO: 45005 - RNA, 296 nt, synthetic construct
  source 1..296: mol_type = other RNA
cgctcttccgcgtctcaagaggtcgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45006 - RNA, 296 nt, synthetic construct
  source 1..296: mol_type = other RNA
cgctcttccgcgtctcaagagggactcgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45007 - RNA, 296 nt, synthetic construct; identical to SEQ ID NO: 43873
  source 1..296: mol_type = other RNA

SEQ ID NO: 45008 - RNA, 296 nt, synthetic construct
  source 1..296: mol_type = other RNA
cgctcttccgcgtctcaagagggacatctcgtcgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45009 - RNA, 296 nt, synthetic construct
  source 1..296: mol_type = other RNA
cgctcttccgcgtctcaagagggacatctcgcgatcgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45010 - RNA, 296 nt, synthetic construct
  source 1..296: mol_type = other RNA
cgctcttccgcgtctcaagagggacatctcgcgattttcggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45011 - RNA, 296 nt, synthetic construct
  source 1..296: mol_type = other RNA
cgctcttccgcgtctcaagagggacatctcgcgatttctttcgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45012 - RNA, 296 nt, synthetic construct
  source 1..296: mol_type = other RNA
cgctcttccgcgtctcaagagggacatctcgcgatttcttgagtcgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45013 - RNA, 296 nt, synthetic construct
  source 1..296: mol_type = other RNA
cgctcttccgcgtctcaagagggacatctcgcgatttcttgagtcttcgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45014 - RNA, 296 nt, synthetic construct
  source 1..296: mol_type = other RNA
cgctcttccgcgtctcaagagggacatctcgcgatttcttgagtctaactcggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45015 - RNA, 296 nt, synthetic construct
  source 1..296: mol_type = other RNA
cgctcttccgcgtctcaagagggacatctcgcgatttcttgagtctaacccctcgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45016 - RNA, 296 nt, synthetic construct
  source 1..296: mol_type = other RNA
cgctcttccgcgtctcaagagggacatctcgcgatttcttgagtctaaccccgtgtcgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45017 - RNA, 296 nt, synthetic construct
  source 1..296: mol_type = other RNA
cgctcttccgcgtctcaagagggacatctcgcgatttcttgagtctaaccccgtgatgtcggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45018 - RNA, 296 nt, synthetic construct
  source 1..296: mol_type = other RNA
cgctcttccgcgtctcaagagggacatctcgcgatttcttgagtctaaccccgtgatgatttcggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45019 - RNA, 296 nt, synthetic construct
  source 1..296: mol_type = other RNA
cgctcttccgcgtctcaagagggacatctcgcgatttcttgagtctaaccccgtgatgattgactcgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45020 - RNA, 296 nt, synthetic construct
  source 1..296: mol_type = other RNA
cgctcttccgcgtctcaagagggacatctcgcgatttcttgagtctaaccccgtgatgattgacgcctcggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45021 - RNA, 296 nt, synthetic construct
  source 1..296: mol_type = other RNA
cgctcttccgcgtctcaagagggacatctcgcgatttcttgagtctaaccccgtgatgattgacgccaaatcggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45022 - RNA, 296 nt, synthetic construct
  source 1..296: mol_type = other RNA
cgctcttccgcgtctcaagagggacatctcgcgatttcttgagtctaaccccgtgatgattgacgccaaagaatcgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45023 - RNA, 296 nt, synthetic construct
  source 1..296: mol_type = other RNA
cgctcttccgcgtctcaagagggacatctcgcgatttcttgagtctaaccccgtgatgattgacgccaaagaagtgtcggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45024 - RNA, 296 nt, synthetic construct
  source 1..296: mol_type = other RNA
cgctcttccgcgtctcaagagggacatctcgcgatttcttgagtctaaccccgtgatgattgacgccaaagaagtgtcttcggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45025 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgcttcgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45026 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcatcgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45027 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacactcggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45028 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggtcgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45029 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcctcgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45030 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttcgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45031 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttactcgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45032 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctcgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45033 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggtcgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45034 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggttcgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45035 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaactcgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45036 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctttcgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45037 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttccttcgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45038 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctcgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45039 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtcgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45040 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactcgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45041 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtcgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45042 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttcggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45043 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtcgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45044 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45045 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctcggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45046 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttcgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45047 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtcggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45048 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattcgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45049 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattcgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45050 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtcggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45051 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtcgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45052 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtcgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45053 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtcggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45054 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatcgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45055 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtcgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45056 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttcggagcacggcagaatagccaagttcagcaaagtgaggaccattaccaccaggtcaaactctataaagcagggcaaagaccagcatttccccgtcttcatgaacgagacgtcggaagagc

SEQ ID NO: 45057 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtcgcacggcagaatagccaagttcagcaaagtgaggaccattaccaccaggtcaaactctataaagcagggcaaagaccagcatttccccgtcttcatgaacgagacgtcggaagagc

SEQ ID NO: 45058 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtcgggcagaatagccaagttcagcaaagtgaggaccattaccaccaggtcaaactctataaagcagggcaaagaccagcatttccccgtcttcatgaacgagacgtcggaagagc

SEQ ID NO: 45059 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactcgagaatagccaagttcagcaaagtgaggaccattaccaccaggtcaaactctataaagcagggcaaagaccagcatttccccgtcttcatgaacgagacgtcggaagagc

SEQ ID NO: 45060 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctcgatagccaagttcagcaaagtgaggaccattaccaccaggtcaaactctataaagcagggcaaagaccagcatttccccgtcttcatgaacgagacgtcggaagagc

SEQ ID NO: 45061 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatcggccaagttcagcaaagtgaggaccattaccaccaggtcaaactctataaagcagggcaaagaccagcatttccccgtcttcatgaacgagacgtcggaagagc

SEQ ID NO: 45062 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatcgaagttcagcaaagtgaggaccattaccaccaggtcaaactctataaagcagggcaaagaccagcatttccccgtcttcatgaacgagacgtcggaagagc

SEQ ID NO: 45063 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctcgttcagcaaagtgaggaccattaccaccaggtcaaactctataaagcagggcaaagaccagcatttccccgtcttcatgaacgagacgtcggaagagc

SEQ ID NO: 45064 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtcgagcaaagtgaggaccattaccaccaggtcaaactctataaagcagggcaaagaccagcatttccccgtcttcatgaacgagacgtcggaagagc

SEQ ID NO: 45065 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctcgaaagtgaggaccattaccaccaggtcaaactctataaagcagggcaaagaccagcatttccccgtcttcatgaacgagacgtcggaagagc

SEQ ID NO: 45066 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctcggtgaggaccattaccaccaggtcaaactctataaagcagggcaaagaccagcatttccccgtcttcatgaacgagacgtcggaagagc

SEQ ID NO: 45067 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatcgaggaccattaccaccaggtcaaactctataaagcagggcaaagaccagcatttccccgtcttcatgaacgagacgtcggaagagc

SEQ ID NO: 45068 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtcgaccattaccaccaggtcaaactctataaagcagggcaaagaccagcatttccccgtcttcatgaacgagacgtcggaagagc

SEQ ID NO: 45069 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtcgattaccaccaggtcaaactctataaagcagggcaaagaccagcatttccccgtcttcatgaacgagacgtcggaagagc

SEQ ID NO: 45070 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctcgaccaccaggtcaaactctataaagcagggcaaagaccagcatttccccgtcttcatgaacgagacgtcggaagagc

SEQ ID NO: 45071 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttcgaccaggtcaaactctataaagcagggcaaagaccagcatttccccgtcttcatgaacgagacgtcggaagagc

SEQ ID NO: 45072 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctcgaggtcaaactctataaagcagggcaaagaccagcatttccccgtcttcatgaacgagacgtcggaagagc

SEQ ID NO: 45073 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctcgtcaaactctataaagcagggcaaagaccagcatttccccgtcttcatgaacgagacgtcggaagagc

SEQ ID NO: 45074 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcgaactctataaagcagggcaaagaccagcatttccccgtcttcatgaacgagacgtcggaagagc

SEQ ID NO: 45075 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatcgtctataaagcagggcaaagaccagcatttccccgtcttcatgaacgagacgtcggaagagc

SEQ ID NO: 45076 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcgataaagcagggcaaagaccagcatttccccgtcttcatgaacgagacgtcggaagagc

SEQ ID NO: 45077 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttcgaagcagggcaaagaccagcatttccccgtcttcatgaacgagacgtcggaagagc

SEQ ID NO: 45078 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatcgcagggcaaagaccagcatttccccgtcttcatgaacgagacgtcggaagagc

SEQ ID NO: 45079 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtcgggcaaagaccagcatttccccgtcttcatgaacgagacgtcggaagagc

SEQ ID NO: 45080 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtcgaaagaccagcatttccccgtcttcatgaacgagacgtcggaagagc

SEQ ID NO: 45081 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctcggaccagcatttccccgtcttcatgaacgagacgtcggaagagc

SEQ ID NO: 45082 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatcgcagcatttccccgtcttcatgaacgagacgtcggaagagc

SEQ ID NO: 45083 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactcgcatttccccgtcttcatgaacgagacgtcggaagagc

SEQ ID NO: 45084 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtcgttccccgtcttcatgaacgagacgtcggaagagc

SEQ ID NO: 45085 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattcgcccgtcttcatgaacgagacgtcggaagagc

SEQ ID NO: 45086 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctcggtcttcatgaacgagacgtcggaagagc

SEQ ID NO: 45087 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctcgttcatgaacgagacgtcggaagagc

SEQ ID NO: 45088 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctcgatgaacgagacgtcggaagagc

SEQ ID NO: 45089 - RNA, 296 nt, synthetic construct
  source 1..296: mol_type = other RNA
cgctcttccgcgtctcaagaggtccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45090 - RNA, 296 nt, synthetic construct
  source 1..296: mol_type = other RNA
cgctcttccgcgtctcaagagggactcctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45091 - RNA, 296 nt, synthetic construct
  source 1..296: mol_type = other RNA
cgctcttccgcgtctcaagagggacatctcccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45092 - RNA, 296 nt, synthetic construct
  source 1..296: mol_type = other RNA
cgctcttccgcgtctcaagagggacatctcgtcctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45093 - RNA, 296 nt, synthetic construct
  source 1..296: mol_type = other RNA
cgctcttccgcgtctcaagagggacatctcgcgatcccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45094 - RNA, 296 nt, synthetic construct
  source 1..296: mol_type = other RNA
cgctcttccgcgtctcaagagggacatctcgcgattttccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45095 - RNA, 296 nt, synthetic construct
  source 1..296: mol_type = other RNA
cgctcttccgcgtctcaagagggacatctcgcgatttctttcctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45096 - RNA, 296 nt, synthetic construct
  source 1..296: mol_type = other RNA
cgctcttccgcgtctcaagagggacatctcgcgatttcttgagtccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45097 - RNA, 296 nt, synthetic construct
  source 1..296: mol_type = other RNA
cgctcttccgcgtctcaagagggacatctcgcgatttcttgagtcttcccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45098 - RNA, 296 nt, synthetic construct
  source 1..296: mol_type = other RNA
cgctcttccgcgtctcaagagggacatctcgcgatttcttgagtctaactccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45099 - RNA, 296 nt, synthetic construct
  source 1..296: mol_type = other RNA
cgctcttccgcgtctcaagagggacatctcgcgatttcttgagtctaacccctccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45100 - RNA, 296 nt, synthetic construct
  source 1..296: mol_type = other RNA
cgctcttccgcgtctcaagagggacatctcgcgatttcttgagtctaaccccgtgtccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45101 - RNA, 296 nt, synthetic construct
  source 1..296: mol_type = other RNA
cgctcttccgcgtctcaagagggacatctcgcgatttcttgagtctaaccccgtgatgtccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45102 - RNA, 296 nt, synthetic construct
  source 1..296: mol_type = other RNA
cgctcttccgcgtctcaagagggacatctcgcgatttcttgagtctaaccccgtgatgatttccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45103 - RNA, 296 nt, synthetic construct
  source 1..296: mol_type = other RNA
cgctcttccgcgtctcaagagggacatctcgcgatttcttgagtctaaccccgtgatgattgactccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45104 - RNA, 296 nt, synthetic construct
  source 1..296: mol_type = other RNA
cgctcttccgcgtctcaagagggacatctcgcgatttcttgagtctaaccccgtgatgattgacgcctccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45105 - RNA, 296 nt, synthetic construct
  source 1..296: mol_type = other RNA
cgctcttccgcgtctcaagagggacatctcgcgatttcttgagtctaaccccgtgatgattgacgccaaatccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45106 - RNA, 296 nt, synthetic construct
  source 1..296: mol_type = other RNA
cgctcttccgcgtctcaagagggacatctcgcgatttcttgagtctaaccccgtgatgattgacgccaaagaatcctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45107 - RNA, 296 nt, synthetic construct
  source 1..296: mol_type = other RNA
cgctcttccgcgtctcaagagggacatctcgcgatttcttgagtctaaccccgtgatgattgacgccaaagaagtgtccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45108 - RNA, 296 nt, synthetic construct
  source 1..296: mol_type = other RNA
cgctcttccgcgtctcaagagggacatctcgcgatttcttgagtctaaccccgtgatgattgacgccaaagaagtgtcttccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45109 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgcttcccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45110 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcatccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45111 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacactccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45112 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggtcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45113 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcctcctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45114 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45115 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttactcctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45116 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45117 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggtccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45118 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggttcccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45119 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaactcccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45120 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctttccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45121 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttccttccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45122 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggctccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45123 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgtccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45124 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaactcccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45125 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggtccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45126 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccttccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45127 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgtcctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45128 - RNA, 296 nt, synthetic construct; identical to SEQ ID NO: 43873
  source 1..296: mol_type = other RNA

SEQ ID NO: 45129 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcctccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45130 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccacttccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45131 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgtccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45132 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaattccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45133 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgattccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45134 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagtccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45135 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgtccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45136 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagtcccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45137 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgtccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45138 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaatcctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45139 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45140 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgttccgagcacggcagaatagccaagttcagcaaagtgaggaccattaccaccaggtcaaactctataaagcagggcaaagaccagcatttccccgtcttcatgaacgagacgtcggaagagc

SEQ ID NO: 45141 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgtcccacggcagaatagccaagttcagcaaagtgaggaccattaccaccaggtcaaactctataaagcagggcaaagaccagcatttccccgtcttcatgaacgagacgtcggaagagc

SEQ ID NO: 45142 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagtccggcagaatagccaagttcagcaaagtgaggaccattaccaccaggtcaaactctataaagcagggcaaagaccagcatttccccgtcttcatgaacgagacgtcggaagagc

SEQ ID NO: 45143 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcactccagaatagccaagttcagcaaagtgaggaccattaccaccaggtcaaactctataaagcagggcaaagaccagcatttccccgtcttcatgaacgagacgtcggaagagc

SEQ ID NO: 45144 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggctccatagccaagttcagcaaagtgaggaccattaccaccaggtcaaactctataaagcagggcaaagaccagcatttccccgtcttcatgaacgagacgtcggaagagc

SEQ ID NO: 45145 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagatccgccaagttcagcaaagtgaggaccattaccaccaggtcaaactctataaagcagggcaaagaccagcatttccccgtcttcatgaacgagacgtcggaagagc

SEQ ID NO: 45146 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatatccaagttcagcaaagtgaggaccattaccaccaggtcaaactctataaagcagggcaaagaccagcatttccccgtcttcatgaacgagacgtcggaagagc

SEQ ID NO: 45147 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcctccttcagcaaagtgaggaccattaccaccaggtcaaactctataaagcagggcaaagaccagcatttccccgtcttcatgaacgagacgtcggaagagc

SEQ ID NO: 45148 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagtccagcaaagtgaggaccattaccaccaggtcaaactctataaagcagggcaaagaccagcatttccccgtcttcatgaacgagacgtcggaagagc

SEQ ID NO: 45149 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttctccaaagtgaggaccattaccaccaggtcaaactctataaagcagggcaaagaccagcatttccccgtcttcatgaacgagacgtcggaagagc

SEQ ID NO: 45150 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagctccgtgaggaccattaccaccaggtcaaactctataaagcagggcaaagaccagcatttccccgtcttcatgaacgagacgtcggaagagc

SEQ ID NO: 45151 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaatccaggaccattaccaccaggtcaaactctataaagcagggcaaagaccagcatttccccgtcttcatgaacgagacgtcggaagagc

SEQ ID NO: 45152 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgtccaccattaccaccaggtcaaactctataaagcagggcaaagaccagcatttccccgtcttcatgaacgagacgtcggaagagc

SEQ ID NO: 45153 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggtccattaccaccaggtcaaactctataaagcagggcaaagaccagcatttccccgtcttcatgaacgagacgtcggaagagc

SEQ ID NO: 45154 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacctccaccaccaggtcaaactctataaagcagggcaaagaccagcatttccccgtcttcatgaacgagacgtcggaagagc

SEQ ID NO: 45155 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatttccaccaggtcaaactctataaagcagggcaaagaccagcatttccccgtcttcatgaacgagacgtcggaagagc

SEQ ID NO: 45156 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacctccaggtcaaactctataaagcagggcaaagaccagcatttccccgtcttcatgaacgagacgtcggaagagc

SEQ ID NO: 45157 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacctcctcaaactctataaagcagggcaaagaccagcatttccccgtcttcatgaacgagacgtcggaagagc

SEQ ID NO: 45158 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtccaactctataaagcagggcaaagaccagcatttccccgtcttcatgaacgagacgtcggaagagc

SEQ ID NO: 45159 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcatcctctataaagcagggcaaagaccagcatttccccgtcttcatgaacgagacgtcggaagagc

SEQ ID NO: 45160 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactccataaagcagggcaaagaccagcatttccccgtcttcatgaacgagacgtcggaagagc

SEQ ID NO: 45161 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactcttccaagcagggcaaagaccagcatttccccgtcttcatgaacgagacgtcggaagagc

SEQ ID NO: 45162 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatatcccagggcaaagaccagcatttccccgtcttcatgaacgagacgtcggaagagc

SEQ ID NO: 45163 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagtccggcaaagaccagcatttccccgtcttcatgaacgagacgtcggaagagc

SEQ ID NO: 45164 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagtccaaagaccagcatttccccgtcttcatgaacgagacgtcggaagagc

SEQ ID NO: 45165 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggctccgaccagcatttccccgtcttcatgaacgagacgtcggaagagc

SEQ ID NO: 45166 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaatcccagcatttccccgtcttcatgaacgagacgtcggaagagc

SEQ ID NO: 45167 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagactcccatttccccgtcttcatgaacgagacgtcggaagagc

SEQ ID NO: 45168 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagtccttccccgtcttcatgaacgagacgtcggaagagc

SEQ ID NO: 45169 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcattcccccgtcttcatgaacgagacgtcggaagagc

SEQ ID NO: 45170 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttctccgtcttcatgaacgagacgtcggaagagc

SEQ ID NO: 45171 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccctccttcatgaacgagacgtcggaagagc

SEQ ID NO: 45172 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtctccatgaacgagacgtcggaagagc

SEQ ID NO: 45173 - RNA, 296 nt, synthetic construct
  source 1..296: mol_type = other RNA
cgctcttccgcgtctcaagagggagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45174 - RNA, 296 nt, synthetic construct
  source 1..296: mol_type = other RNA
cgctcttccgcgtctcaagagggacgagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45175 - RNA, 296 nt, synthetic construct
  source 1..296: mol_type = other RNA
cgctcttccgcgtctcaagagggacatcgagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45176 - RNA, 296 nt, synthetic construct
  source 1..296: mol_type = other RNA
cgctcttccgcgtctcaagagggacatctcggagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45177 - RNA, 296 nt, synthetic construct
  source 1..296: mol_type = other RNA
cgctcttccgcgtctcaagagggacatctcgcgagagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45178 - RNA, 296 nt, synthetic construct
  source 1..296: mol_type = other RNA
cgctcttccgcgtctcaagagggacatctcgcgatttgaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45179 - RNA, 296 nt, synthetic construct; identical to SEQ ID NO: 43873
  source 1..296: mol_type = other RNA

SEQ ID NO: 45180 - RNA, 296 nt, synthetic construct
  source 1..296: mol_type = other RNA
cgctcttccgcgtctcaagagggacatctcgcgatttcttgaggagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45181 - RNA, 296 nt, synthetic construct
  source 1..296: mol_type = other RNA
cgctcttccgcgtctcaagagggacatctcgcgatttcttgagtctgagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45182 - RNA, 296 nt, synthetic construct
  source 1..296: mol_type = other RNA
cgctcttccgcgtctcaagagggacatctcgcgatttcttgagtctaacgaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45183 - RNA, 296 nt, synthetic construct
  source 1..296: mol_type = other RNA
cgctcttccgcgtctcaagagggacatctcgcgatttcttgagtctaaccccgagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45184 - RNA, 296 nt, synthetic construct
  source 1..296: mol_type = other RNA
cgctcttccgcgtctcaagagggacatctcgcgatttcttgagtctaaccccgtggagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45185 - RNA, 296 nt, synthetic construct
  source 1..296: mol_type = other RNA
cgctcttccgcgtctcaagagggacatctcgcgatttcttgagtctaaccccgtgatggaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45186 - RNA, 296 nt, synthetic construct
  source 1..296: mol_type = other RNA
cgctcttccgcgtctcaagagggacatctcgcgatttcttgagtctaaccccgtgatgattgaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45187 - RNA, 296 nt, synthetic construct
  source 1..296: mol_type = other RNA
cgctcttccgcgtctcaagagggacatctcgcgatttcttgagtctaaccccgtgatgattgacgagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45188 - RNA, 296 nt, synthetic construct
  source 1..296: mol_type = other RNA
cgctcttccgcgtctcaagagggacatctcgcgatttcttgagtctaaccccgtgatgattgacgccgaggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45189 - RNA, 296 nt, synthetic construct
  source 1..296: mol_type = other RNA
cgctcttccgcgtctcaagagggacatctcgcgatttcttgagtctaaccccgtgatgattgacgccaaagaggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45190 - RNA, 296 nt, synthetic construct
  source 1..296: mol_type = other RNA
cgctcttccgcgtctcaagagggacatctcgcgatttcttgagtctaaccccgtgatgattgacgccaaagaagagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45191 - RNA, 296 nt, synthetic construct
  source 1..296: mol_type = other RNA
cgctcttccgcgtctcaagagggacatctcgcgatttcttgagtctaaccccgtgatgattgacgccaaagaagtggaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45192 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45193 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45194 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcagagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45195 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacgaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45196 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45197 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccgagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45198 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtgagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45199 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacgagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45200 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcgagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45201 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgggagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45202 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtgagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45203 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacgagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45204 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttgagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45205 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45206 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45207 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45208 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45209 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45210 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45211 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45212 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45213 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45214 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45215 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45216 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45217 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45218 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45219 - RNA, 296 nt, synthetic construct; identical to SEQ ID NO: 43873
  source 1..296: mol_type = other RNA

SEQ ID NO: 45220 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45221 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggaggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45222 - RNA, 296 nt, synthetic construct; identical to SEQ ID NO: 43873
  source 1..296: mol_type = other RNA

SEQ ID NO: 45223 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45224 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgaggagcacggcagaatagccaagttcagcaaagtgaggaccattaccaccaggtcaaactctataaagcagggcaaagaccagcatttccccgtcttcatgaacgagacgtcggaagagc

SEQ ID NO: 45225 - RNA, 296 nt, synthetic construct; identical to SEQ ID NO: 43873
  source 1..296: mol_type = other RNA

SEQ ID NO: 45226 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggagggcagaatagccaagttcagcaaagtgaggaccattaccaccaggtcaaactctataaagcagggcaaagaccagcatttccccgtcttcatgaacgagacgtcggaagagc

SEQ ID NO: 45227 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgagagaatagccaagttcagcaaagtgaggaccattaccaccaggtcaaactctataaagcagggcaaagaccagcatttccccgtcttcatgaacgagacgtcggaagagc

SEQ ID NO: 45228 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgagatagccaagttcagcaaagtgaggaccattaccaccaggtcaaactctataaagcagggcaaagaccagcatttccccgtcttcatgaacgagacgtcggaagagc

SEQ ID NO: 45229 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagaggccaagttcagcaaagtgaggaccattaccaccaggtcaaactctataaagcagggcaaagaccagcatttccccgtcttcatgaacgagacgtcggaagagc

SEQ ID NO: 45230 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagagaagttcagcaaagtgaggaccattaccaccaggtcaaactctataaagcagggcaaagaccagcatttccccgtcttcatgaacgagacgtcggaagagc

SEQ ID NO: 45231 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgagttcagcaaagtgaggaccattaccaccaggtcaaactctataaagcagggcaaagaccagcatttccccgtcttcatgaacgagacgtcggaagagc

SEQ ID NO: 45232 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggagagcaaagtgaggaccattaccaccaggtcaaactctataaagcagggcaaagaccagcatttccccgtcttcatgaacgagacgtcggaagagc

SEQ ID NO: 45233 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgagaaagtgaggaccattaccaccaggtcaaactctataaagcagggcaaagaccagcatttccccgtcttcatgaacgagacgtcggaagagc

SEQ ID NO: 45234 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgaggtgaggaccattaccaccaggtcaaactctataaagcagggcaaagaccagcatttccccgtcttcatgaacgagacgtcggaagagc

SEQ ID NO: 45235 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagagaggaccattaccaccaggtcaaactctataaagcagggcaaagaccagcatttccccgtcttcatgaacgagacgtcggaagagc

SEQ ID NO: 45236 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggagaccattaccaccaggtcaaactctataaagcagggcaaagaccagcatttccccgtcttcatgaacgagacgtcggaagagc

SEQ ID NO: 45237 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggagattaccaccaggtcaaactctataaagcagggcaaagaccagcatttccccgtcttcatgaacgagacgtcggaagagc

SEQ ID NO: 45238 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgagaccaccaggtcaaactctataaagcagggcaaagaccagcatttccccgtcttcatgaacgagacgtcggaagagc

SEQ ID NO: 45239 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgagaccaggtcaaactctataaagcagggcaaagaccagcatttccccgtcttcatgaacgagacgtcggaagagc

SEQ ID NO: 45240 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgagaggtcaaactctataaagcagggcaaagaccagcatttccccgtcttcatgaacgagacgtcggaagagc

SEQ ID NO: 45241 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgagtcaaactctataaagcagggcaaagaccagcatttccccgtcttcatgaacgagacgtcggaagagc

SEQ ID NO: 45242 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggagaactctataaagcagggcaaagaccagcatttccccgtcttcatgaacgagacgtcggaagagc

SEQ ID NO: 45243 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagagtctataaagcagggcaaagaccagcatttccccgtcttcatgaacgagacgtcggaagagc

SEQ ID NO: 45244 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgagataaagcagggcaaagaccagcatttccccgtcttcatgaacgagacgtcggaagagc

SEQ ID NO: 45245 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgagaagcagggcaaagaccagcatttccccgtcttcatgaacgagacgtcggaagagc

SEQ ID NO: 45246 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagagcagggcaaagaccagcatttccccgtcttcatgaacgagacgtcggaagagc

SEQ ID NO: 45247 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggagggcaaagaccagcatttccccgtcttcatgaacgagacgtcggaagagc

SEQ ID NO: 45248 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggagaaagaccagcatttccccgtcttcatgaacgagacgtcggaagagc

SEQ ID NO: 45249 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgaggaccagcatttccccgtcttcatgaacgagacgtcggaagagc

SEQ ID NO: 45250 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagagcagcatttccccgtcttcatgaacgagacgtcggaagagc

SEQ ID NO: 45251 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgagcatttccccgtcttcatgaacgagacgtcggaagagc

SEQ ID NO: 45252 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggagttccccgtcttcatgaacgagacgtcggaagagc

SEQ ID NO: 45253 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgagcccgtcttcatgaacgagacgtcggaagagc

SEQ ID NO: 45254 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgaggtcttcatgaacgagacgtcggaagagc

SEQ ID NO: 45255 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgagttcatgaacgagacgtcggaagagc

SEQ ID NO: 45256 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgagatgaacgagacgtcggaagagc

SEQ ID NO: 45257 - RNA, 296 nt, synthetic construct; identical to SEQ ID NO: 43873
  source 1..296: mol_type = other RNA

SEQ ID NO: 45258 - RNA, 296 nt, synthetic construct
  source 1..296: mol_type = other RNA
cgctcttccgcgtctcaagagggacgactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45259 - RNA, 296 nt, synthetic construct
  source 1..296: mol_type = other RNA
cgctcttccgcgtctcaagagggacatcgaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45260 - RNA, 296 nt, synthetic construct
  source 1..296: mol_type = other RNA
cgctcttccgcgtctcaagagggacatctcggactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45261 - RNA, 296 nt, synthetic construct
  source 1..296: mol_type = other RNA
cgctcttccgcgtctcaagagggacatctcgcgagaccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45262 - RNA, 296 nt, synthetic construct
  source 1..296: mol_type = other RNA
cgctcttccgcgtctcaagagggacatctcgcgatttgacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45263 - RNA, 296 nt, synthetic construct
  source 1..296: mol_type = other RNA
cgctcttccgcgtctcaagagggacatctcgcgatttcttgactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45264 - RNA, 296 nt, synthetic construct
  source 1..296: mol_type = other RNA
cgctcttccgcgtctcaagagggacatctcgcgatttcttgaggacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45265 - RNA, 296 nt, synthetic construct
  source 1..296: mol_type = other RNA
cgctcttccgcgtctcaagagggacatctcgcgatttcttgagtctgaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45266 - RNA, 296 nt, synthetic construct
  source 1..296: mol_type = other RNA
cgctcttccgcgtctcaagagggacatctcgcgatttcttgagtctaacgacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45267 - RNA, 296 nt, synthetic construct
  source 1..296: mol_type = other RNA
cgctcttccgcgtctcaagagggacatctcgcgatttcttgagtctaaccccgacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45268 - RNA, 296 nt, synthetic construct
  source 1..296: mol_type = other RNA
cgctcttccgcgtctcaagagggacatctcgcgatttcttgagtctaaccccgtggacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45269 - RNA, 296 nt, synthetic construct
  source 1..296: mol_type = other RNA
cgctcttccgcgtctcaagagggacatctcgcgatttcttgagtctaaccccgtgatggacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45270 - RNA, 296 nt, synthetic construct; identical to SEQ ID NO: 43873
  source 1..296: mol_type = other RNA

SEQ ID NO: 45271 - RNA, 296 nt, synthetic construct
  source 1..296: mol_type = other RNA
cgctcttccgcgtctcaagagggacatctcgcgatttcttgagtctaaccccgtgatgattgacgacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45272 - RNA, 296 nt, synthetic construct
  source 1..296: mol_type = other RNA
cgctcttccgcgtctcaagagggacatctcgcgatttcttgagtctaaccccgtgatgattgacgccgacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45273 - RNA, 296 nt, synthetic construct
  source 1..296: mol_type = other RNA
cgctcttccgcgtctcaagagggacatctcgcgatttcttgagtctaaccccgtgatgattgacgccaaagacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45274 - RNA, 296 nt, synthetic construct
  source 1..296: mol_type = other RNA
cgctcttccgcgtctcaagagggacatctcgcgatttcttgagtctaaccccgtgatgattgacgccaaagaagactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45275 - RNA, 296 nt, synthetic construct
  source 1..296: mol_type = other RNA
cgctcttccgcgtctcaagagggacatctcgcgatttcttgagtctaaccccgtgatgattgacgccaaagaagtggacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45276 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45277 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgaccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45278 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcagacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45279 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacgacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45280 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45281 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccgactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45282 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtgacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45283 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacgactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45284 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcgacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45285 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgggacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45286 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtgaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45287 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacgaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45288 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttgacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45289 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45290 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45291 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45292 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45293 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45294 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45295 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45296 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45297 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45298 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45299 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45300 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45301 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45302 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45303 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45304 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45305 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45306 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45307 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45308 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgacgagcacggcagaatagccaagttcagcaaagtgaggaccattaccaccaggtcaaactctataaagcagggcaaagaccagcatttccccgtcttcatgaacgagacgtcggaagagc

SEQ ID NO: 45309 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaccacggcagaatagccaagttcagcaaagtgaggaccattaccaccaggtcaaactctataaagcagggcaaagaccagcatttccccgtcttcatgaacgagacgtcggaagagc

SEQ ID NO: 45310 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggacggcagaatagccaagttcagcaaagtgaggaccattaccaccaggtcaaactctataaagcagggcaaagaccagcatttccccgtcttcatgaacgagacgtcggaagagc

SEQ ID NO: 45311 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgacagaatagccaagttcagcaaagtgaggaccattaccaccaggtcaaactctataaagcagggcaaagaccagcatttccccgtcttcatgaacgagacgtcggaagagc

SEQ ID NO: 45312 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgacatagccaagttcagcaaagtgaggaccattaccaccaggtcaaactctataaagcagggcaaagaccagcatttccccgtcttcatgaacgagacgtcggaagagc

SEQ ID NO: 45313 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagacgccaagttcagcaaagtgaggaccattaccaccaggtcaaactctataaagcagggcaaagaccagcatttccccgtcttcatgaacgagacgtcggaagagc

SEQ ID NO: 45314 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagacaagttcagcaaagtgaggaccattaccaccaggtcaaactctataaagcagggcaaagaccagcatttccccgtcttcatgaacgagacgtcggaagagc

SEQ ID NO: 45315 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgacttcagcaaagtgaggaccattaccaccaggtcaaactctataaagcagggcaaagaccagcatttccccgtcttcatgaacgagacgtcggaagagc

SEQ ID NO: 45316 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggacagcaaagtgaggaccattaccaccaggtcaaactctataaagcagggcaaagaccagcatttccccgtcttcatgaacgagacgtcggaagagc

SEQ ID NO: 45317 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgacaaagtgaggaccattaccaccaggtcaaactctataaagcagggcaaagaccagcatttccccgtcttcatgaacgagacgtcggaagagc

SEQ ID NO: 45318 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgacgtgaggaccattaccaccaggtcaaactctataaagcagggcaaagaccagcatttccccgtcttcatgaacgagacgtcggaagagc

SEQ ID NO: 45319 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagacaggaccattaccaccaggtcaaactctataaagcagggcaaagaccagcatttccccgtcttcatgaacgagacgtcggaagagc

SEQ ID NO: 45320 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggacaccattaccaccaggtcaaactctataaagcagggcaaagaccagcatttccccgtcttcatgaacgagacgtcggaagagc

SEQ ID NO: 45321 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggacattaccaccaggtcaaactctataaagcagggcaaagaccagcatttccccgtcttcatgaacgagacgtcggaagagc

SEQ ID NO: 45322 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgacaccaccaggtcaaactctataaagcagggcaaagaccagcatttccccgtcttcatgaacgagacgtcggaagagc

SEQ ID NO: 45323 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgacaccaggtcaaactctataaagcagggcaaagaccagcatttccccgtcttcatgaacgagacgtcggaagagc

SEQ ID NO: 45324 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgacaggtcaaactctataaagcagggcaaagaccagcatttccccgtcttcatgaacgagacgtcggaagagc

SEQ ID NO: 45325 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgactcaaactctataaagcagggcaaagaccagcatttccccgtcttcatgaacgagacgtcggaagagc

SEQ ID NO: 45326 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggacaactctataaagcagggcaaagaccagcatttccccgtcttcatgaacgagacgtcggaagagc

SEQ ID NO: 45327 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagactctataaagcagggcaaagaccagcatttccccgtcttcatgaacgagacgtcggaagagc

SEQ ID NO: 45328 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgacataaagcagggcaaagaccagcatttccccgtcttcatgaacgagacgtcggaagagc

SEQ ID NO: 45329 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgacaagcagggcaaagaccagcatttccccgtcttcatgaacgagacgtcggaagagc

SEQ ID NO: 45330 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagaccagggcaaagaccagcatttccccgtcttcatgaacgagacgtcggaagagc

SEQ ID NO: 45331 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggacggcaaagaccagcatttccccgtcttcatgaacgagacgtcggaagagc

SEQ ID NO: 45332 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggacaaagaccagcatttccccgtcttcatgaacgagacgtcggaagagc

SEQ ID NO: 45333 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgacgaccagcatttccccgtcttcatgaacgagacgtcggaagagc

SEQ ID NO: 45334 - RNA, 296 nt, synthetic construct; identical to SEQ ID NO: 43873
  source 1..296: mol_type = other RNA

SEQ ID NO: 45335 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgaccatttccccgtcttcatgaacgagacgtcggaagagc

SEQ ID NO: 45336 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggacttccccgtcttcatgaacgagacgtcggaagagc

SEQ ID NO: 45337 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgaccccgtcttcatgaacgagacgtcggaagagc

SEQ ID NO: 45338 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgacgtcttcatgaacgagacgtcggaagagc

SEQ ID NO: 45339 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgacttcatgaacgagacgtcggaagagc

SEQ ID NO: 45340 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgacatgaacgagacgtcggaagagc

SEQ ID NO: 45341 - RNA, 296 nt, synthetic construct
  source 1..296: mol_type = other RNA
cgctcttccgcgtctcaagagggtgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45342 - RNA, 296 nt, synthetic construct
  source 1..296: mol_type = other RNA
cgctcttccgcgtctcaagagggacgtgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45343 - RNA, 296 nt, synthetic construct
  source 1..296: mol_type = other RNA
cgctcttccgcgtctcaagagggacatcgtgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45344 - RNA, 296 nt, synthetic construct
  source 1..296: mol_type = other RNA
cgctcttccgcgtctcaagagggacatctcggtgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45345 - RNA, 296 nt, synthetic construct
  source 1..296: mol_type = other RNA
cgctcttccgcgtctcaagagggacatctcgcgagtgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45346 - RNA, 296 nt, synthetic construct
  source 1..296: mol_type = other RNA
cgctcttccgcgtctcaagagggacatctcgcgatttgtggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45347 - RNA, 296 nt, synthetic construct
  source 1..296: mol_type = other RNA
cgctcttccgcgtctcaagagggacatctcgcgatttcttgtgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45348 - RNA, 296 nt, synthetic construct
  source 1..296: mol_type = other RNA
cgctcttccgcgtctcaagagggacatctcgcgatttcttgaggtgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45349 - RNA, 296 nt, synthetic construct
  source 1..296: mol_type = other RNA
cgctcttccgcgtctcaagagggacatctcgcgatttcttgagtctgtgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45350 - RNA, 296 nt, synthetic construct
  source 1..296: mol_type = other RNA
cgctcttccgcgtctcaagagggacatctcgcgatttcttgagtctaacgtggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45351 - RNA, 296 nt, synthetic construct; identical to SEQ ID NO: 43873
  source 1..296: mol_type = other RNA

SEQ ID NO: 45352 - RNA, 296 nt, synthetic construct
  source 1..296: mol_type = other RNA
cgctcttccgcgtctcaagagggacatctcgcgatttcttgagtctaaccccgtggtgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45353 - RNA, 296 nt, synthetic construct
  source 1..296: mol_type = other RNA
cgctcttccgcgtctcaagagggacatctcgcgatttcttgagtctaaccccgtgatggtggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45354 - RNA, 296 nt, synthetic construct
  source 1..296: mol_type = other RNA
cgctcttccgcgtctcaagagggacatctcgcgatttcttgagtctaaccccgtgatgattgtggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45355 - RNA, 296 nt, synthetic construct
  source 1..296: mol_type = other RNA
cgctcttccgcgtctcaagagggacatctcgcgatttcttgagtctaaccccgtgatgattgacgtgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45356 - RNA, 296 nt, synthetic construct
  source 1..296: mol_type = other RNA
cgctcttccgcgtctcaagagggacatctcgcgatttcttgagtctaaccccgtgatgattgacgccgtggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45357 - RNA, 296 nt, synthetic construct
  source 1..296: mol_type = other RNA
cgctcttccgcgtctcaagagggacatctcgcgatttcttgagtctaaccccgtgatgattgacgccaaagtggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45358 - RNA, 296 nt, synthetic construct; identical to SEQ ID NO: 43873
  source 1..296: mol_type = other RNA

SEQ ID NO: 45359 - RNA, 296 nt, synthetic construct
  source 1..296: mol_type = other RNA
cgctcttccgcgtctcaagagggacatctcgcgatttcttgagtctaaccccgtgatgattgacgccaaagaagtggtggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45360 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgtggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45361 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgtgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45362 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcagtgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45363 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacgtggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45364 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggtgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45365 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccgtgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45366 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtgtgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45367 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacgtgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45368 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcgtgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45369 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgggtgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45370 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtgtgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45371 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacgtgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45372 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttgtgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45373 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgtgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45374 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgtgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45375 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggtgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45376 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgtgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45377 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggtgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45378 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgtggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45379 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggtgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45380 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagtgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45381 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgtggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45382 - RNA, 296 nt, synthetic construct; identical to SEQ ID NO: 43873
  source 1..296: mol_type = other RNA

SEQ ID NO: 45383 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggtggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45384 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgtgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45385 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgtgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45386 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggtggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45387 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggtgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45388 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggtgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45389 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggtggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45390 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagtgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45391 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggtgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45392 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgtggagcacggcagaatagccaagttcagcaaagtgaggaccattaccaccaggtcaaactctataaagcagggcaaagaccagcatttccccgtcttcatgaacgagacgtcggaagagc

SEQ ID NO: 45393 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggtgcacggcagaatagccaagttcagcaaagtgaggaccattaccaccaggtcaaactctataaagcagggcaaagaccagcatttccccgtcttcatgaacgagacgtcggaagagc

SEQ ID NO: 45394 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggtgggcagaatagccaagttcagcaaagtgaggaccattaccaccaggtcaaactctataaagcagggcaaagaccagcatttccccgtcttcatgaacgagacgtcggaagagc

SEQ ID NO: 45395 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgtgagaatagccaagttcagcaaagtgaggaccattaccaccaggtcaaactctataaagcagggcaaagaccagcatttccccgtcttcatgaacgagacgtcggaagagc

SEQ ID NO: 45396 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgtgatagccaagttcagcaaagtgaggaccattaccaccaggtcaaactctataaagcagggcaaagaccagcatttccccgtcttcatgaacgagacgtcggaagagc

SEQ ID NO: 45397 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagtggccaagttcagcaaagtgaggaccattaccaccaggtcaaactctataaagcagggcaaagaccagcatttccccgtcttcatgaacgagacgtcggaagagc

SEQ ID NO: 45398 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagtgaagttcagcaaagtgaggaccattaccaccaggtcaaactctataaagcagggcaaagaccagcatttccccgtcttcatgaacgagacgtcggaagagc

SEQ ID NO: 45399 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgtgttcagcaaagtgaggaccattaccaccaggtcaaactctataaagcagggcaaagaccagcatttccccgtcttcatgaacgagacgtcggaagagc

SEQ ID NO: 45400 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggtgagcaaagtgaggaccattaccaccaggtcaaactctataaagcagggcaaagaccagcatttccccgtcttcatgaacgagacgtcggaagagc

SEQ ID NO: 45401 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgtgaaagtgaggaccattaccaccaggtcaaactctataaagcagggcaaagaccagcatttccccgtcttcatgaacgagacgtcggaagagc

SEQ ID NO: 45402 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgtggtgaggaccattaccaccaggtcaaactctataaagcagggcaaagaccagcatttccccgtcttcatgaacgagacgtcggaagagc

SEQ ID NO: 45403 - RNA, 296 nt, synthetic construct; identical to SEQ ID NO: 43873
  source 1..296: mol_type = other RNA

SEQ ID NO: 45404 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggtgaccattaccaccaggtcaaactctataaagcagggcaaagaccagcatttccccgtcttcatgaacgagacgtcggaagagc

SEQ ID NO: 45405 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggtgattaccaccaggtcaaactctataaagcagggcaaagaccagcatttccccgtcttcatgaacgagacgtcggaagagc

SEQ ID NO: 45406 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgtgaccaccaggtcaaactctataaagcagggcaaagaccagcatttccccgtcttcatgaacgagacgtcggaagagc

SEQ ID NO: 45407 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgtgaccaggtcaaactctataaagcagggcaaagaccagcatttccccgtcttcatgaacgagacgtcggaagagc

SEQ ID NO: 45408 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgtgaggtcaaactctataaagcagggcaaagaccagcatttccccgtcttcatgaacgagacgtcggaagagc

SEQ ID NO: 45409 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgtgtcaaactctataaagcagggcaaagaccagcatttccccgtcttcatgaacgagacgtcggaagagc

SEQ ID NO: 45410 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggtgaactctataaagcagggcaaagaccagcatttccccgtcttcatgaacgagacgtcggaagagc

SEQ ID NO: 45411 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagtgtctataaagcagggcaaagaccagcatttccccgtcttcatgaacgagacgtcggaagagc

SEQ ID NO: 45412 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgtgataaagcagggcaaagaccagcatttccccgtcttcatgaacgagacgtcggaagagc

SEQ ID NO: 45413 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgtgaagcagggcaaagaccagcatttccccgtcttcatgaacgagacgtcggaagagc

SEQ ID NO: 45414 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagtgcagggcaaagaccagcatttccccgtcttcatgaacgagacgtcggaagagc

SEQ ID NO: 45415 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggtgggcaaagaccagcatttccccgtcttcatgaacgagacgtcggaagagc

SEQ ID NO: 45416 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggtgaaagaccagcatttccccgtcttcatgaacgagacgtcggaagagc

SEQ ID NO: 45417 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgtggaccagcatttccccgtcttcatgaacgagacgtcggaagagc

SEQ ID NO: 45418 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagtgcagcatttccccgtcttcatgaacgagacgtcggaagagc

SEQ ID NO: 45419 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgtgcatttccccgtcttcatgaacgagacgtcggaagagc

SEQ ID NO: 45420 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggtgttccccgtcttcatgaacgagacgtcggaagagc

SEQ ID NO: 45421 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgtgcccgtcttcatgaacgagacgtcggaagagc

SEQ ID NO: 45422 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgtggtcttcatgaacgagacgtcggaagagc

SEQ ID NO: 45423 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtgttcatgaacgagacgtcggaagagc

SEQ ID NO: 45424 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgtgatgaacgagacgtcggaagagc

SEQ ID NO: 45425 - RNA, 296 nt, synthetic construct
  source 1..296: mol_type = other RNA
cgctcttccgcgtctcaagagggtcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45426 - RNA, 296 nt, synthetic construct
  source 1..296: mol_type = other RNA
cgctcttccgcgtctcaagagggacgtctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45427 - RNA, 296 nt, synthetic construct
  source 1..296: mol_type = other RNA
cgctcttccgcgtctcaagagggacatcgtccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45428 - RNA, 296 nt, synthetic construct
  source 1..296: mol_type = other RNA
cgctcttccgcgtctcaagagggacatctcggtctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45429 - RNA, 296 nt, synthetic construct
  source 1..296: mol_type = other RNA
cgctcttccgcgtctcaagagggacatctcgcgagtccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45430 - RNA, 296 nt, synthetic construct
  source 1..296: mol_type = other RNA
cgctcttccgcgtctcaagagggacatctcgcgatttgtcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45431 - RNA, 296 nt, synthetic construct
  source 1..296: mol_type = other RNA
cgctcttccgcgtctcaagagggacatctcgcgatttcttgtctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45432 - RNA, 296 nt, synthetic construct
  source 1..296: mol_type = other RNA
cgctcttccgcgtctcaagagggacatctcgcgatttcttgaggtcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45433 - RNA, 296 nt, synthetic construct
  source 1..296: mol_type = other RNA
cgctcttccgcgtctcaagagggacatctcgcgatttcttgagtctgtccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45434 - RNA, 296 nt, synthetic construct
  source 1..296: mol_type = other RNA
cgctcttccgcgtctcaagagggacatctcgcgatttcttgagtctaacgtcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45435 - RNA, 296 nt, synthetic construct
  source 1..296: mol_type = other RNA
cgctcttccgcgtctcaagagggacatctcgcgatttcttgagtctaaccccgtcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45436 - RNA, 296 nt, synthetic construct
  source 1..296: mol_type = other RNA
cgctcttccgcgtctcaagagggacatctcgcgatttcttgagtctaaccccgtggtcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45437 - RNA, 296 nt, synthetic construct
  source 1..296: mol_type = other RNA
cgctcttccgcgtctcaagagggacatctcgcgatttcttgagtctaaccccgtgatggtcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45438 - RNA, 296 nt, synthetic construct
  source 1..296: mol_type = other RNA
cgctcttccgcgtctcaagagggacatctcgcgatttcttgagtctaaccccgtgatgattgtcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45439 - RNA, 296 nt, synthetic construct
  source 1..296: mol_type = other RNA
cgctcttccgcgtctcaagagggacatctcgcgatttcttgagtctaaccccgtgatgattgacgtcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45440 - RNA, 296 nt, synthetic construct
  source 1..296: mol_type = other RNA
cgctcttccgcgtctcaagagggacatctcgcgatttcttgagtctaaccccgtgatgattgacgccgtcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45441 - RNA, 296 nt, synthetic construct
  source 1..296: mol_type = other RNA
cgctcttccgcgtctcaagagggacatctcgcgatttcttgagtctaaccccgtgatgattgacgccaaagtcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45442 - RNA, 296 nt, synthetic construct
  source 1..296: mol_type = other RNA
cgctcttccgcgtctcaagagggacatctcgcgatttcttgagtctaaccccgtgatgattgacgccaaagaagtctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45443 - RNA, 296 nt, synthetic construct
  source 1..296: mol_type = other RNA
cgctcttccgcgtctcaagagggacatctcgcgatttcttgagtctaaccccgtgatgattgacgccaaagaagtggtcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45444 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgtcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45445 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgtccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45446 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcagtcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45447 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacgtcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45448 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggtccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45449 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccgtctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45450 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtgtcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45451 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacgtctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45452 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcgtcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45453 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgggtcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45454 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtgtccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45455 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacgtccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45456 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttgtcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45457 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgtcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45458 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgtcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45459 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggtcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45460 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgtccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45461 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggtcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45462 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgtcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45463 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggtctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45464 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagtcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45465 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgtcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45466 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45467 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggtcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45468 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgtcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45469 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgtcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45470 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggtcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45471 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggtcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45472 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggtccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45473 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggtcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45474 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagtctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45475 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggtcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45476 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgtcgagcacggcagaatagccaagttcagcaaagtgaggaccattaccaccaggtcaaactctataaagcagggcaaagaccagcatttccccgtcttcatgaacgagacgtcggaagagc

SEQ ID NO: 45477 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggtccacggcagaatagccaagttcagcaaagtgaggaccattaccaccaggtcaaactctataaagcagggcaaagaccagcatttccccgtcttcatgaacgagacgtcggaagagc

SEQ ID NO: 45478 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggtcggcagaatagccaagttcagcaaagtgaggaccattaccaccaggtcaaactctataaagcagggcaaagaccagcatttccccgtcttcatgaacgagacgtcggaagagc

SEQ ID NO: 45479 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgtcagaatagccaagttcagcaaagtgaggaccattaccaccaggtcaaactctataaagcagggcaaagaccagcatttccccgtcttcatgaacgagacgtcggaagagc

SEQ ID NO: 45480 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgtcatagccaagttcagcaaagtgaggaccattaccaccaggtcaaactctataaagcagggcaaagaccagcatttccccgtcttcatgaacgagacgtcggaagagc

SEQ ID NO: 45481 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagtcgccaagttcagcaaagtgaggaccattaccaccaggtcaaactctataaagcagggcaaagaccagcatttccccgtcttcatgaacgagacgtcggaagagc

SEQ ID NO: 45482 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagtcaagttcagcaaagtgaggaccattaccaccaggtcaaactctataaagcagggcaaagaccagcatttccccgtcttcatgaacgagacgtcggaagagc

SEQ ID NO: 45483 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgtcttcagcaaagtgaggaccattaccaccaggtcaaactctataaagcagggcaaagaccagcatttccccgtcttcatgaacgagacgtcggaagagc

SEQ ID NO: 45484 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggtcagcaaagtgaggaccattaccaccaggtcaaactctataaagcagggcaaagaccagcatttccccgtcttcatgaacgagacgtcggaagagc

SEQ ID NO: 45485 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgtcaaagtgaggaccattaccaccaggtcaaactctataaagcagggcaaagaccagcatttccccgtcttcatgaacgagacgtcggaagagc

SEQ ID NO: 45486 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgtcgtgaggaccattaccaccaggtcaaactctataaagcagggcaaagaccagcatttccccgtcttcatgaacgagacgtcggaagagc

SEQ ID NO: 45487 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtcaggaccattaccaccaggtcaaactctataaagcagggcaaagaccagcatttccccgtcttcatgaacgagacgtcggaagagc

SEQ ID NO: 45488 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggtcaccattaccaccaggtcaaactctataaagcagggcaaagaccagcatttccccgtcttcatgaacgagacgtcggaagagc

SEQ ID NO: 45489 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggtcattaccaccaggtcaaactctataaagcagggcaaagaccagcatttccccgtcttcatgaacgagacgtcggaagagc

SEQ ID NO: 45490 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgtcaccaccaggtcaaactctataaagcagggcaaagaccagcatttccccgtcttcatgaacgagacgtcggaagagc

SEQ ID NO: 45491 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgtcaccaggtcaaactctataaagcagggcaaagaccagcatttccccgtcttcatgaacgagacgtcggaagagc

SEQ ID NO: 45492 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgtcaggtcaaactctataaagcagggcaaagaccagcatttccccgtcttcatgaacgagacgtcggaagagc

SEQ ID NO: 45493 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgtctcaaactctataaagcagggcaaagaccagcatttccccgtcttcatgaacgagacgtcggaagagc

SEQ ID NO: 45494 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggtcaactctataaagcagggcaaagaccagcatttccccgtcttcatgaacgagacgtcggaagagc

SEQ ID NO: 45495 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagtctctataaagcagggcaaagaccagcatttccccgtcttcatgaacgagacgtcggaagagc

SEQ ID NO: 45496 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgtcataaagcagggcaaagaccagcatttccccgtcttcatgaacgagacgtcggaagagc

SEQ ID NO: 45497 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgtcaagcagggcaaagaccagcatttccccgtcttcatgaacgagacgtcggaagagc

SEQ ID NO: 45498 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagtccagggcaaagaccagcatttccccgtcttcatgaacgagacgtcggaagagc

SEQ ID NO: 45499 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggtcggcaaagaccagcatttccccgtcttcatgaacgagacgtcggaagagc

SEQ ID NO: 45500 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggtcaaagaccagcatttccccgtcttcatgaacgagacgtcggaagagc

SEQ ID NO: 45501 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgtcgaccagcatttccccgtcttcatgaacgagacgtcggaagagc

SEQ ID NO: 45502 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagtccagcatttccccgtcttcatgaacgagacgtcggaagagc

SEQ ID NO: 45503 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgtccatttccccgtcttcatgaacgagacgtcggaagagc

SEQ ID NO: 45504 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggtcttccccgtcttcatgaacgagacgtcggaagagc

SEQ ID NO: 45505 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgtccccgtcttcatgaacgagacgtcggaagagc

SEQ ID NO: 45506 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgtcgtcttcatgaacgagacgtcggaagagc

SEQ ID NO: 45507 - RNA, 296 nt, synthetic construct; identical to SEQ ID NO: 43873
  source 1..296: mol_type = other RNA

SEQ ID NO: 45508 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgtcatgaacgagacgtcggaagagc

SEQ ID NO: 45509 - RNA, 296 nt, synthetic construct
  source 1..296: mol_type = other RNA
cgctcttccgcgtctcaagagggggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45510 - RNA, 296 nt, synthetic construct
  source 1..296: mol_type = other RNA
cgctcttccgcgtctcaagagggacgggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45511 - RNA, 296 nt, synthetic construct
  source 1..296: mol_type = other RNA
cgctcttccgcgtctcaagagggacatcgggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45512 - RNA, 296 nt, synthetic construct
  source 1..296: mol_type = other RNA
cgctcttccgcgtctcaagagggacatctcggggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45513 - RNA, 296 nt, synthetic construct
  source 1..296: mol_type = other RNA
cgctcttccgcgtctcaagagggacatctcgcgagggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45514 - RNA, 296 nt, synthetic construct
  source 1..296: mol_type = other RNA
cgctcttccgcgtctcaagagggacatctcgcgatttggggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45515 - RNA, 296 nt, synthetic construct
  source 1..296: mol_type = other RNA
cgctcttccgcgtctcaagagggacatctcgcgatttcttgggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45516 - RNA, 296 nt, synthetic construct
  source 1..296: mol_type = other RNA
cgctcttccgcgtctcaagagggacatctcgcgatttcttgaggggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45517 - RNA, 296 nt, synthetic construct
  source 1..296: mol_type = other RNA
cgctcttccgcgtctcaagagggacatctcgcgatttcttgagtctgggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45518 - RNA, 296 nt, synthetic construct
  source 1..296: mol_type = other RNA
cgctcttccgcgtctcaagagggacatctcgcgatttcttgagtctaacggggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45519 - RNA, 296 nt, synthetic construct
  source 1..296: mol_type = other RNA
cgctcttccgcgtctcaagagggacatctcgcgatttcttgagtctaaccccgggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45520 - RNA, 296 nt, synthetic construct
  source 1..296: mol_type = other RNA
cgctcttccgcgtctcaagagggacatctcgcgatttcttgagtctaaccccgtggggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45521 - RNA, 296 nt, synthetic construct
  source 1..296: mol_type = other RNA
cgctcttccgcgtctcaagagggacatctcgcgatttcttgagtctaaccccgtgatgggggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45522 - RNA, 296 nt, synthetic construct
  source 1..296: mol_type = other RNA
cgctcttccgcgtctcaagagggacatctcgcgatttcttgagtctaaccccgtgatgattggggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45523 - RNA, 296 nt, synthetic construct
  source 1..296: mol_type = other RNA
cgctcttccgcgtctcaagagggacatctcgcgatttcttgagtctaaccccgtgatgattgacgggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45524 - RNA, 296 nt, synthetic construct
  source 1..296: mol_type = other RNA
cgctcttccgcgtctcaagagggacatctcgcgatttcttgagtctaaccccgtgatgattgacgccggggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45525 - RNA, 296 nt, synthetic construct
  source 1..296: mol_type = other RNA
cgctcttccgcgtctcaagagggacatctcgcgatttcttgagtctaaccccgtgatgattgacgccaaaggggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45526 - RNA, 296 nt, synthetic construct
  source 1..296: mol_type = other RNA
cgctcttccgcgtctcaagagggacatctcgcgatttcttgagtctaaccccgtgatgattgacgccaaagaagggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45527 - RNA, 296 nt, synthetic construct
  source 1..296: mol_type = other RNA
cgctcttccgcgtctcaagagggacatctcgcgatttcttgagtctaaccccgtgatgattgacgccaaagaagtgggggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45528 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctggggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45529 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45530 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcagggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45531 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacggggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45532 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45533 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccgggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45534 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtgggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45535 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacgggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45536 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcgggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45537 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgggggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45538 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtgggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45539 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacgggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45540 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttgggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45541 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45542 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45543 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45544 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45545 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45546 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctggggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45547 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45548 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45549 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccggggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45550 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45551 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgggggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45552 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45553 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45554 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagggggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45555 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45556 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45557 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgggggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45558 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45559 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45560 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtggggagcacggcagaatagccaagttcagcaaagtgaggaccattaccaccaggtcaaactctataaagcagggcaaagaccagcatttccccgtcttcatgaacgagacgtcggaagagc

SEQ ID NO: 45561 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggggcacggcagaatagccaagttcagcaaagtgaggaccattaccaccaggtcaaactctataaagcagggcaaagaccagcatttccccgtcttcatgaacgagacgtcggaagagc

SEQ ID NO: 45562 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggggggcagaatagccaagttcagcaaagtgaggaccattaccaccaggtcaaactctataaagcagggcaaagaccagcatttccccgtcttcatgaacgagacgtcggaagagc

SEQ ID NO: 45563 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgggagaatagccaagttcagcaaagtgaggaccattaccaccaggtcaaactctataaagcagggcaaagaccagcatttccccgtcttcatgaacgagacgtcggaagagc

SEQ ID NO: 45564 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgggatagccaagttcagcaaagtgaggaccattaccaccaggtcaaactctataaagcagggcaaagaccagcatttccccgtcttcatgaacgagacgtcggaagagc

SEQ ID NO: 45565 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaggggccaagttcagcaaagtgaggaccattaccaccaggtcaaactctataaagcagggcaaagaccagcatttccccgtcttcatgaacgagacgtcggaagagc

SEQ ID NO: 45566 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagggaagttcagcaaagtgaggaccattaccaccaggtcaaactctataaagcagggcaaagaccagcatttccccgtcttcatgaacgagacgtcggaagagc

SEQ ID NO: 45567 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgggttcagcaaagtgaggaccattaccaccaggtcaaactctataaagcagggcaaagaccagcatttccccgtcttcatgaacgagacgtcggaagagc

SEQ ID NO: 45568 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggggagcaaagtgaggaccattaccaccaggtcaaactctataaagcagggcaaagaccagcatttccccgtcttcatgaacgagacgtcggaagagc

SEQ ID NO: 45569 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgggaaagtgaggaccattaccaccaggtcaaactctataaagcagggcaaagaccagcatttccccgtcttcatgaacgagacgtcggaagagc

SEQ ID NO: 45570 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcggggtgaggaccattaccaccaggtcaaactctataaagcagggcaaagaccagcatttccccgtcttcatgaacgagacgtcggaagagc

SEQ ID NO: 45571 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagggaggaccattaccaccaggtcaaactctataaagcagggcaaagaccagcatttccccgtcttcatgaacgagacgtcggaagagc

SEQ ID NO: 45572 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggggaccattaccaccaggtcaaactctataaagcagggcaaagaccagcatttccccgtcttcatgaacgagacgtcggaagagc

SEQ ID NO: 45573 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggggattaccaccaggtcaaactctataaagcagggcaaagaccagcatttccccgtcttcatgaacgagacgtcggaagagc

SEQ ID NO: 45574 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgggaccaccaggtcaaactctataaagcagggcaaagaccagcatttccccgtcttcatgaacgagacgtcggaagagc

SEQ ID NO: 45575 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgggaccaggtcaaactctataaagcagggcaaagaccagcatttccccgtcttcatgaacgagacgtcggaagagc

SEQ ID NO: 45576 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgggaggtcaaactctataaagcagggcaaagaccagcatttccccgtcttcatgaacgagacgtcggaagagc

SEQ ID NO: 45577 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgggtcaaactctataaagcagggcaaagaccagcatttccccgtcttcatgaacgagacgtcggaagagc

SEQ ID NO: 45578 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggggaactctataaagcagggcaaagaccagcatttccccgtcttcatgaacgagacgtcggaagagc

SEQ ID NO: 45579 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagggtctataaagcagggcaaagaccagcatttccccgtcttcatgaacgagacgtcggaagagc

SEQ ID NO: 45580 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgggataaagcagggcaaagaccagcatttccccgtcttcatgaacgagacgtcggaagagc

SEQ ID NO: 45581 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgggaagcagggcaaagaccagcatttccccgtcttcatgaacgagacgtcggaagagc

SEQ ID NO: 45582 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagggcagggcaaagaccagcatttccccgtcttcatgaacgagacgtcggaagagc

SEQ ID NO: 45583 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggggggcaaagaccagcatttccccgtcttcatgaacgagacgtcggaagagc

SEQ ID NO: 45584 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggggaaagaccagcatttccccgtcttcatgaacgagacgtcggaagagc

SEQ ID NO: 45585 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcggggaccagcatttccccgtcttcatgaacgagacgtcggaagagc

SEQ ID NO: 45586 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagggcagcatttccccgtcttcatgaacgagacgtcggaagagc

SEQ ID NO: 45587 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgggcatttccccgtcttcatgaacgagacgtcggaagagc

SEQ ID NO: 45588 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggggttccccgtcttcatgaacgagacgtcggaagagc

SEQ ID NO: 45589 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgggcccgtcttcatgaacgagacgtcggaagagc

SEQ ID NO: 45590 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcggggtcttcatgaacgagacgtcggaagagc

SEQ ID NO: 45591 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgggttcatgaacgagacgtcggaagagc

SEQ ID NO: 45592 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgggatgaacgagacgtcggaagagc

SEQ ID NO: 45593 - RNA, 296 nt, synthetic construct
  source 1..296: mol_type = other RNA
cgctcttccgcgtctcaagaggggcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45594 - RNA, 296 nt, synthetic construct
  source 1..296: mol_type = other RNA
cgctcttccgcgtctcaagagggacggctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45595 - RNA, 296 nt, synthetic construct
  source 1..296: mol_type = other RNA
cgctcttccgcgtctcaagagggacatcggccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45596 - RNA, 296 nt, synthetic construct
  source 1..296: mol_type = other RNA
cgctcttccgcgtctcaagagggacatctcgggctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45597 - RNA, 296 nt, synthetic construct
  source 1..296: mol_type = other RNA
cgctcttccgcgtctcaagagggacatctcgcgaggccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45598 - RNA, 296 nt, synthetic construct
  source 1..296: mol_type = other RNA
cgctcttccgcgtctcaagagggacatctcgcgatttggcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45599 - RNA, 296 nt, synthetic construct
  source 1..296: mol_type = other RNA
cgctcttccgcgtctcaagagggacatctcgcgatttcttggctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45600 - RNA, 296 nt, synthetic construct
  source 1..296: mol_type = other RNA
cgctcttccgcgtctcaagagggacatctcgcgatttcttgagggcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45601 - RNA, 296 nt, synthetic construct
  source 1..296: mol_type = other RNA
cgctcttccgcgtctcaagagggacatctcgcgatttcttgagtctggccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45602 - RNA, 296 nt, synthetic construct
  source 1..296: mol_type = other RNA
cgctcttccgcgtctcaagagggacatctcgcgatttcttgagtctaacggcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45603 - RNA, 296 nt, synthetic construct
  source 1..296: mol_type = other RNA
cgctcttccgcgtctcaagagggacatctcgcgatttcttgagtctaaccccggcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45604 - RNA, 296 nt, synthetic construct
  source 1..296: mol_type = other RNA
cgctcttccgcgtctcaagagggacatctcgcgatttcttgagtctaaccccgtgggcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45605 - RNA, 296 nt, synthetic construct
  source 1..296: mol_type = other RNA
cgctcttccgcgtctcaagagggacatctcgcgatttcttgagtctaaccccgtgatgggcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45606 - RNA, 296 nt, synthetic construct
  source 1..296: mol_type = other RNA
cgctcttccgcgtctcaagagggacatctcgcgatttcttgagtctaaccccgtgatgattggcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45607 - RNA, 296 nt, synthetic construct
  source 1..296: mol_type = other RNA
cgctcttccgcgtctcaagagggacatctcgcgatttcttgagtctaaccccgtgatgattgacggcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45608 - RNA, 296 nt, synthetic construct
  source 1..296: mol_type = other RNA
cgctcttccgcgtctcaagagggacatctcgcgatttcttgagtctaaccccgtgatgattgacgccggcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45609 - RNA, 296 nt, synthetic construct
  source 1..296: mol_type = other RNA
cgctcttccgcgtctcaagagggacatctcgcgatttcttgagtctaaccccgtgatgattgacgccaaaggcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45610 - RNA, 296 nt, synthetic construct
  source 1..296: mol_type = other RNA
cgctcttccgcgtctcaagagggacatctcgcgatttcttgagtctaaccccgtgatgattgacgccaaagaaggctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45611 - RNA, 296 nt, synthetic construct
  source 1..296: mol_type = other RNA
cgctcttccgcgtctcaagagggacatctcgcgatttcttgagtctaaccccgtgatgattgacgccaaagaagtgggcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45612 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctggcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45613 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctggccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45614 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaggcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45615 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacggcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45616 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggggccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45617 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccggctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45618 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtggcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45619 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacggctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45620 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcggcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45621 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45622 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtggccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45623 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacggccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45624 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttggcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45625 - RNA, 296 nt, synthetic construct; identical to SEQ ID NO: 43873
  source 1..296: mol_type = other RNA

SEQ ID NO: 45626 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcggcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45627 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgggcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45628 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacggccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45629 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggggcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45630 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctggcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45631 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgggctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45632 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaggcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45633 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccggcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45634 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactggcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45635 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgggcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45636 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatggcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45637 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatggcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45638 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagggcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45639 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgggcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45640 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagggccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45641 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgggcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45642 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaggctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45643 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagggcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45644 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtggcgagcacggcagaatagccaagttcagcaaagtgaggaccattaccaccaggtcaaactctataaagcagggcaaagaccagcatttccccgtcttcatgaacgagacgtcggaagagc

SEQ ID NO: 45645 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgggccacggcagaatagccaagttcagcaaagtgaggaccattaccaccaggtcaaactctataaagcagggcaaagaccagcatttccccgtcttcatgaacgagacgtcggaagagc

SEQ ID NO: 45646 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagggcggcagaatagccaagttcagcaaagtgaggaccattaccaccaggtcaaactctataaagcagggcaaagaccagcatttccccgtcttcatgaacgagacgtcggaagagc

SEQ ID NO: 45647 - RNA, 296 nt, synthetic construct; identical to SEQ ID NO: 43873
  source 1..296: mol_type = other RNA

SEQ ID NO: 45648 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcggcatagccaagttcagcaaagtgaggaccattaccaccaggtcaaactctataaagcagggcaaagaccagcatttccccgtcttcatgaacgagacgtcggaagagc

SEQ ID NO: 45649 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaggcgccaagttcagcaaagtgaggaccattaccaccaggtcaaactctataaagcagggcaaagaccagcatttccccgtcttcatgaacgagacgtcggaagagc

SEQ ID NO: 45650 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataggcaagttcagcaaagtgaggaccattaccaccaggtcaaactctataaagcagggcaaagaccagcatttccccgtcttcatgaacgagacgtcggaagagc

SEQ ID NO: 45651 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccggcttcagcaaagtgaggaccattaccaccaggtcaaactctataaagcagggcaaagaccagcatttccccgtcttcatgaacgagacgtcggaagagc

SEQ ID NO: 45652 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagggcagcaaagtgaggaccattaccaccaggtcaaactctataaagcagggcaaagaccagcatttccccgtcttcatgaacgagacgtcggaagagc

SEQ ID NO: 45653 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcggcaaagtgaggaccattaccaccaggtcaaactctataaagcagggcaaagaccagcatttccccgtcttcatgaacgagacgtcggaagagc

SEQ ID NO: 45654 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcggcgtgaggaccattaccaccaggtcaaactctataaagcagggcaaagaccagcatttccccgtcttcatgaacgagacgtcggaagagc

SEQ ID NO: 45655 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaggcaggaccattaccaccaggtcaaactctataaagcagggcaaagaccagcatttccccgtcttcatgaacgagacgtcggaagagc

SEQ ID NO: 45656 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgggcaccattaccaccaggtcaaactctataaagcagggcaaagaccagcatttccccgtcttcatgaacgagacgtcggaagagc

SEQ ID NO: 45657 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggggcattaccaccaggtcaaactctataaagcagggcaaagaccagcatttccccgtcttcatgaacgagacgtcggaagagc

SEQ ID NO: 45658 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccggcaccaccaggtcaaactctataaagcagggcaaagaccagcatttccccgtcttcatgaacgagacgtcggaagagc

SEQ ID NO: 45659 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattggcaccaggtcaaactctataaagcagggcaaagaccagcatttccccgtcttcatgaacgagacgtcggaagagc

SEQ ID NO: 45660 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccggcaggtcaaactctataaagcagggcaaagaccagcatttccccgtcttcatgaacgagacgtcggaagagc

SEQ ID NO: 45661 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccggctcaaactctataaagcagggcaaagaccagcatttccccgtcttcatgaacgagacgtcggaagagc

SEQ ID NO: 45662 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggggcaactctataaagcagggcaaagaccagcatttccccgtcttcatgaacgagacgtcggaagagc

SEQ ID NO: 45663 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaggctctataaagcagggcaaagaccagcatttccccgtcttcatgaacgagacgtcggaagagc

SEQ ID NO: 45664 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacggcataaagcagggcaaagaccagcatttccccgtcttcatgaacgagacgtcggaagagc

SEQ ID NO: 45665 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctggcaagcagggcaaagaccagcatttccccgtcttcatgaacgagacgtcggaagagc

SEQ ID NO: 45666 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataggccagggcaaagaccagcatttccccgtcttcatgaacgagacgtcggaagagc

SEQ ID NO: 45667 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagggcggcaaagaccagcatttccccgtcttcatgaacgagacgtcggaagagc

SEQ ID NO: 45668 - RNA, 296 nt, synthetic construct; identical to SEQ ID NO: 43873
  source 1..296: mol_type = other RNA

SEQ ID NO: 45669 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcggcgaccagcatttccccgtcttcatgaacgagacgtcggaagagc

SEQ ID NO: 45670 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaggccagcatttccccgtcttcatgaacgagacgtcggaagagc

SEQ ID NO: 45671 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacggccatttccccgtcttcatgaacgagacgtcggaagagc

SEQ ID NO: 45672 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagggcttccccgtcttcatgaacgagacgtcggaagagc

SEQ ID NO: 45673 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatggccccgtcttcatgaacgagacgtcggaagagc

SEQ ID NO: 45674 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcggcgtcttcatgaacgagacgtcggaagagc

SEQ ID NO: 45675 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccggcttcatgaacgagacgtcggaagagc

SEQ ID NO: 45676 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcggcatgaacgagacgtcggaagagc

SEQ ID NO: 45677 - RNA, 296 nt, synthetic construct
  source 1..296: mol_type = other RNA
cgctcttccgcgtctcaagagggcgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45678 - RNA, 296 nt, synthetic construct
  source 1..296: mol_type = other RNA
cgctcttccgcgtctcaagagggacgcgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45679 - RNA, 296 nt, synthetic construct
  source 1..296: mol_type = other RNA
cgctcttccgcgtctcaagagggacatcgcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45680 - RNA, 296 nt, synthetic construct
  source 1..296: mol_type = other RNA
cgctcttccgcgtctcaagagggacatctcggcgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45681 - RNA, 296 nt, synthetic construct
  source 1..296: mol_type = other RNA
cgctcttccgcgtctcaagagggacatctcgcgagcgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45682 - RNA, 296 nt, synthetic construct
  source 1..296: mol_type = other RNA
cgctcttccgcgtctcaagagggacatctcgcgatttgcggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45683 - RNA, 296 nt, synthetic construct
  source 1..296: mol_type = other RNA
cgctcttccgcgtctcaagagggacatctcgcgatttcttgcgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45684 - RNA, 296 nt, synthetic construct
  source 1..296: mol_type = other RNA
cgctcttccgcgtctcaagagggacatctcgcgatttcttgaggcgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45685 - RNA, 296 nt, synthetic construct
  source 1..296: mol_type = other RNA
cgctcttccgcgtctcaagagggacatctcgcgatttcttgagtctgcgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45686 - RNA, 296 nt, synthetic construct
  source 1..296: mol_type = other RNA
cgctcttccgcgtctcaagagggacatctcgcgatttcttgagtctaacgcggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45687 - RNA, 296 nt, synthetic construct
  source 1..296: mol_type = other RNA
cgctcttccgcgtctcaagagggacatctcgcgatttcttgagtctaaccccgcgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45688 - RNA, 296 nt, synthetic construct
  source 1..296: mol_type = other RNA
cgctcttccgcgtctcaagagggacatctcgcgatttcttgagtctaaccccgtggcgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45689 - RNA, 296 nt, synthetic construct
  source 1..296: mol_type = other RNA
cgctcttccgcgtctcaagagggacatctcgcgatttcttgagtctaaccccgtgatggcggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45690 - RNA, 296 nt, synthetic construct
  source 1..296: mol_type = other RNA
cgctcttccgcgtctcaagagggacatctcgcgatttcttgagtctaaccccgtgatgattgcggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45691 - RNA, 296 nt, synthetic construct
  source 1..296: mol_type = other RNA
cgctcttccgcgtctcaagagggacatctcgcgatttcttgagtctaaccccgtgatgattgacgcgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45692 - RNA, 296 nt, synthetic construct
  source 1..296: mol_type = other RNA
cgctcttccgcgtctcaagagggacatctcgcgatttcttgagtctaaccccgtgatgattgacgccgcggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45693 - RNA, 296 nt, synthetic construct
  source 1..296: mol_type = other RNA
cgctcttccgcgtctcaagagggacatctcgcgatttcttgagtctaaccccgtgatgattgacgccaaagcggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45694 - RNA, 296 nt, synthetic construct
  source 1..296: mol_type = other RNA
cgctcttccgcgtctcaagagggacatctcgcgatttcttgagtctaaccccgtgatgattgacgccaaagaagcgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45695 - RNA, 296 nt, synthetic construct
  source 1..296: mol_type = other RNA
cgctcttccgcgtctcaagagggacatctcgcgatttcttgagtctaaccccgtgatgattgacgccaaagaagtggcggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45696 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgcggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45697 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45698 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcagcgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45699 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacgcggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45700 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45701 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccgcgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45702 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtgcgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45703 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacgcgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45704 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcgcgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45705 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgggcgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45706 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtgcgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45707 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacgcgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45708 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttgcgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45709 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgcgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45710 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgcgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45711 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggcgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45712 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgcgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45713 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggcgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45714 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgcggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45715 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45716 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagcgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45717 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgcggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45718 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgcgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45719 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggcggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45720 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgcgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45721 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgcgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45722 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggcggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45723 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggcgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45724 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggcgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45725 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggcggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45726 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagcgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45727 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggcgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45728 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgcggagcacggcagaatagccaagttcagcaaagtgaggaccattaccaccaggtcaaactctataaagcagggcaaagaccagcatttccccgtcttcatgaacgagacgtcggaagagc

SEQ ID NO: 45729 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggcgcacggcagaatagccaagttcagcaaagtgaggaccattaccaccaggtcaaactctataaagcagggcaaagaccagcatttccccgtcttcatgaacgagacgtcggaagagc

SEQ ID NO: 45730 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggcgggcagaatagccaagttcagcaaagtgaggaccattaccaccaggtcaaactctataaagcagggcaaagaccagcatttccccgtcttcatgaacgagacgtcggaagagc

SEQ ID NO: 45731 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgcgagaatagccaagttcagcaaagtgaggaccattaccaccaggtcaaactctataaagcagggcaaagaccagcatttccccgtcttcatgaacgagacgtcggaagagc

SEQ ID NO: 45732 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgcgatagccaagttcagcaaagtgaggaccattaccaccaggtcaaactctataaagcagggcaaagaccagcatttccccgtcttcatgaacgagacgtcggaagagc

SEQ ID NO: 45733 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagcggccaagttcagcaaagtgaggaccattaccaccaggtcaaactctataaagcagggcaaagaccagcatttccccgtcttcatgaacgagacgtcggaagagc

SEQ ID NO: 45734 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcgaagttcagcaaagtgaggaccattaccaccaggtcaaactctataaagcagggcaaagaccagcatttccccgtcttcatgaacgagacgtcggaagagc

SEQ ID NO: 45735 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgcgttcagcaaagtgaggaccattaccaccaggtcaaactctataaagcagggcaaagaccagcatttccccgtcttcatgaacgagacgtcggaagagc

SEQ ID NO: 45736 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggcgagcaaagtgaggaccattaccaccaggtcaaactctataaagcagggcaaagaccagcatttccccgtcttcatgaacgagacgtcggaagagc

SEQ ID NO: 45737 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgcgaaagtgaggaccattaccaccaggtcaaactctataaagcagggcaaagaccagcatttccccgtcttcatgaacgagacgtcggaagagc

SEQ ID NO: 45738 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgcggtgaggaccattaccaccaggtcaaactctataaagcagggcaaagaccagcatttccccgtcttcatgaacgagacgtcggaagagc

SEQ ID NO: 45739 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagcgaggaccattaccaccaggtcaaactctataaagcagggcaaagaccagcatttccccgtcttcatgaacgagacgtcggaagagc

SEQ ID NO: 45740 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggcgaccattaccaccaggtcaaactctataaagcagggcaaagaccagcatttccccgtcttcatgaacgagacgtcggaagagc

SEQ ID NO: 45741 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggcgattaccaccaggtcaaactctataaagcagggcaaagaccagcatttccccgtcttcatgaacgagacgtcggaagagc

SEQ ID NO: 45742 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgcgaccaccaggtcaaactctataaagcagggcaaagaccagcatttccccgtcttcatgaacgagacgtcggaagagc

SEQ ID NO: 45743 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgcgaccaggtcaaactctataaagcagggcaaagaccagcatttccccgtcttcatgaacgagacgtcggaagagc

SEQ ID NO: 45744 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgcgaggtcaaactctataaagcagggcaaagaccagcatttccccgtcttcatgaacgagacgtcggaagagc

SEQ ID NO: 45745 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgcgtcaaactctataaagcagggcaaagaccagcatttccccgtcttcatgaacgagacgtcggaagagc

SEQ ID NO: 45746 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggcgaactctataaagcagggcaaagaccagcatttccccgtcttcatgaacgagacgtcggaagagc

SEQ ID NO: 45747 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagcgtctataaagcagggcaaagaccagcatttccccgtcttcatgaacgagacgtcggaagagc

SEQ ID NO: 45748 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgcgataaagcagggcaaagaccagcatttccccgtcttcatgaacgagacgtcggaagagc

SEQ ID NO: 45749 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgcgaagcagggcaaagaccagcatttccccgtcttcatgaacgagacgtcggaagagc

SEQ ID NO: 45750 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagcgcagggcaaagaccagcatttccccgtcttcatgaacgagacgtcggaagagc

SEQ ID NO: 45751 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggcgggcaaagaccagcatttccccgtcttcatgaacgagacgtcggaagagc

SEQ ID NO: 45752 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggcgaaagaccagcatttccccgtcttcatgaacgagacgtcggaagagc

SEQ ID NO: 45753 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgcggaccagcatttccccgtcttcatgaacgagacgtcggaagagc

SEQ ID NO: 45754 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagcgcagcatttccccgtcttcatgaacgagacgtcggaagagc

SEQ ID NO: 45755 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgcgcatttccccgtcttcatgaacgagacgtcggaagagc

SEQ ID NO: 45756 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggcgttccccgtcttcatgaacgagacgtcggaagagc

SEQ ID NO: 45757 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgcgcccgtcttcatgaacgagacgtcggaagagc

SEQ ID NO: 45758 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgcggtcttcatgaacgagacgtcggaagagc

SEQ ID NO: 45759 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgcgttcatgaacgagacgtcggaagagc

SEQ ID NO: 45760 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgcgatgaacgagacgtcggaagagc

SEQ ID NO: 45761 - RNA, 296 nt, synthetic construct
  source 1..296: mol_type = other RNA
cgctcttccgcgtctcaagagggccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45762 - RNA, 296 nt, synthetic construct
  source 1..296: mol_type = other RNA
cgctcttccgcgtctcaagagggacgcctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45763 - RNA, 296 nt, synthetic construct
  source 1..296: mol_type = other RNA
cgctcttccgcgtctcaagagggacatcgcccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45764 - RNA, 296 nt, synthetic construct
  source 1..296: mol_type = other RNA
cgctcttccgcgtctcaagagggacatctcggcctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45765 - RNA, 296 nt, synthetic construct
  source 1..296: mol_type = other RNA
cgctcttccgcgtctcaagagggacatctcgcgagcccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45766 - RNA, 296 nt, synthetic construct
  source 1..296: mol_type = other RNA
cgctcttccgcgtctcaagagggacatctcgcgatttgccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45767 - RNA, 296 nt, synthetic construct
  source 1..296: mol_type = other RNA
cgctcttccgcgtctcaagagggacatctcgcgatttcttgcctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45768 - RNA, 296 nt, synthetic construct
  source 1..296: mol_type = other RNA
cgctcttccgcgtctcaagagggacatctcgcgatttcttgaggccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45769 - RNA, 296 nt, synthetic construct
  source 1..296: mol_type = other RNA
cgctcttccgcgtctcaagagggacatctcgcgatttcttgagtctgcccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45770 - RNA, 296 nt, synthetic construct
  source 1..296: mol_type = other RNA
cgctcttccgcgtctcaagagggacatctcgcgatttcttgagtctaacgccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45771 - RNA, 296 nt, synthetic construct
  source 1..296: mol_type = other RNA
cgctcttccgcgtctcaagagggacatctcgcgatttcttgagtctaaccccgccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45772 - RNA, 296 nt, synthetic construct
  source 1..296: mol_type = other RNA
cgctcttccgcgtctcaagagggacatctcgcgatttcttgagtctaaccccgtggccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45773 - RNA, 296 nt, synthetic construct
  source 1..296: mol_type = other RNA
cgctcttccgcgtctcaagagggacatctcgcgatttcttgagtctaaccccgtgatggccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45774 - RNA, 296 nt, synthetic construct
  source 1..296: mol_type = other RNA
cgctcttccgcgtctcaagagggacatctcgcgatttcttgagtctaaccccgtgatgattgccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45775 - RNA, 296 nt, synthetic construct; identical to SEQ ID NO: 43873
  source 1..296: mol_type = other RNA

SEQ ID NO: 45776 - RNA, 296 nt, synthetic construct
  source 1..296: mol_type = other RNA
cgctcttccgcgtctcaagagggacatctcgcgatttcttgagtctaaccccgtgatgattgacgccgccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45777 - RNA, 296 nt, synthetic construct
  source 1..296: mol_type = other RNA
cgctcttccgcgtctcaagagggacatctcgcgatttcttgagtctaaccccgtgatgattgacgccaaagccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45778 - RNA, 296 nt, synthetic construct
  source 1..296: mol_type = other RNA
cgctcttccgcgtctcaagagggacatctcgcgatttcttgagtctaaccccgtgatgattgacgccaaagaagcctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45779 - RNA, 296 nt, synthetic construct
  source 1..296: mol_type = other RNA
cgctcttccgcgtctcaagagggacatctcgcgatttcttgagtctaaccccgtgatgattgacgccaaagaagtggccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45780 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45781 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45782 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcagccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45783 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacgccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45784 - RNA, 296 nt, synthetic construct; identical to SEQ ID NO: 43873
  source 1..296: mol_type = other RNA

SEQ ID NO: 45785 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccgcctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45786 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtgccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45787 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacgcctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45788 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcgccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45789 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctgggccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45790 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtgcccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45791 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacgcccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45792 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttgccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45793 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctgccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45794 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcgccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45795 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatggccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45796 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacgcccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45797 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagggccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45798 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctgccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45799 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45800 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcagccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45801 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccgccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45802 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45803 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtggccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45804 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45805 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatgccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45806 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataaggccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45807 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45808 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggaggcccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45809 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctggccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45810 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagcctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45811 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagaggccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45812 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtgccgagcacggcagaatagccaagttcagcaaagtgaggaccattaccaccaggtcaaactctataaagcagggcaaagaccagcatttccccgtcttcatgaacgagacgtcggaagagc

SEQ ID NO: 45813 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggcccacggcagaatagccaagttcagcaaagtgaggaccattaccaccaggtcaaactctataaagcagggcaaagaccagcatttccccgtcttcatgaacgagacgtcggaagagc

SEQ ID NO: 45814 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggaggccggcagaatagccaagttcagcaaagtgaggaccattaccaccaggtcaaactctataaagcagggcaaagaccagcatttccccgtcttcatgaacgagacgtcggaagagc

SEQ ID NO: 45815 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacgccagaatagccaagttcagcaaagtgaggaccattaccaccaggtcaaactctataaagcagggcaaagaccagcatttccccgtcttcatgaacgagacgtcggaagagc

SEQ ID NO: 45816 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcgccatagccaagttcagcaaagtgaggaccattaccaccaggtcaaactctataaagcagggcaaagaccagcatttccccgtcttcatgaacgagacgtcggaagagc

SEQ ID NO: 45817 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagagccgccaagttcagcaaagtgaggaccattaccaccaggtcaaactctataaagcagggcaaagaccagcatttccccgtcttcatgaacgagacgtcggaagagc

SEQ ID NO: 45818 - RNA, 296 nt, synthetic construct; identical to SEQ ID NO: 43873
  source 1..296: mol_type = other RNA

SEQ ID NO: 45819 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccgccttcagcaaagtgaggaccattaccaccaggtcaaactctataaagcagggcaaagaccagcatttccccgtcttcatgaacgagacgtcggaagagc

SEQ ID NO: 45820 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaaggccagcaaagtgaggaccattaccaccaggtcaaactctataaagcagggcaaagaccagcatttccccgtcttcatgaacgagacgtcggaagagc

SEQ ID NO: 45821 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcgccaaagtgaggaccattaccaccaggtcaaactctataaagcagggcaaagaccagcatttccccgtcttcatgaacgagacgtcggaagagc

SEQ ID NO: 45822 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcgccgtgaggaccattaccaccaggtcaaactctataaagcagggcaaagaccagcatttccccgtcttcatgaacgagacgtcggaagagc

SEQ ID NO: 45823 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagccaggaccattaccaccaggtcaaactctataaagcagggcaaagaccagcatttccccgtcttcatgaacgagacgtcggaagagc

SEQ ID NO: 45824 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtggccaccattaccaccaggtcaaactctataaagcagggcaaagaccagcatttccccgtcttcatgaacgagacgtcggaagagc

SEQ ID NO: 45825 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagggccattaccaccaggtcaaactctataaagcagggcaaagaccagcatttccccgtcttcatgaacgagacgtcggaagagc

SEQ ID NO: 45826 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccgccaccaccaggtcaaactctataaagcagggcaaagaccagcatttccccgtcttcatgaacgagacgtcggaagagc

SEQ ID NO: 45827 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattgccaccaggtcaaactctataaagcagggcaaagaccagcatttccccgtcttcatgaacgagacgtcggaagagc

SEQ ID NO: 45828 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccgccaggtcaaactctataaagcagggcaaagaccagcatttccccgtcttcatgaacgagacgtcggaagagc

SEQ ID NO: 45829 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccgcctcaaactctataaagcagggcaaagaccagcatttccccgtcttcatgaacgagacgtcggaagagc

SEQ ID NO: 45830 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagggccaactctataaagcagggcaaagaccagcatttccccgtcttcatgaacgagacgtcggaagagc

SEQ ID NO: 45831 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcagcctctataaagcagggcaaagaccagcatttccccgtcttcatgaacgagacgtcggaagagc

SEQ ID NO: 45832 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacgccataaagcagggcaaagaccagcatttccccgtcttcatgaacgagacgtcggaagagc

SEQ ID NO: 45833 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctgccaagcagggcaaagaccagcatttccccgtcttcatgaacgagacgtcggaagagc

SEQ ID NO: 45834 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatagcccagggcaaagaccagcatttccccgtcttcatgaacgagacgtcggaagagc

SEQ ID NO: 45835 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaaggccggcaaagaccagcatttccccgtcttcatgaacgagacgtcggaagagc

SEQ ID NO: 45836 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcaggccaaagaccagcatttccccgtcttcatgaacgagacgtcggaagagc

SEQ ID NO: 45837 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcgccgaccagcatttccccgtcttcatgaacgagacgtcggaagagc

SEQ ID NO: 45838 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagcccagcatttccccgtcttcatgaacgagacgtcggaagagc

SEQ ID NO: 45839 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacgcccatttccccgtcttcatgaacgagacgtcggaagagc

SEQ ID NO: 45840 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaggccttccccgtcttcatgaacgagacgtcggaagagc

SEQ ID NO: 45841 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatgcccccgtcttcatgaacgagacgtcggaagagc

SEQ ID NO: 45842 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcgccgtcttcatgaacgagacgtcggaagagc

SEQ ID NO: 45843 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgccttcatgaacgagacgtcggaagagc

SEQ ID NO: 45844 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcgccatgaacgagacgtcggaagagc

SEQ ID NO: 45845 - RNA, 296 nt, synthetic construct
  source 1..296: mol_type = other RNA
cgctcttccgcgtctcaagaggcagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45846 - RNA, 296 nt, synthetic construct
  source 1..296: mol_type = other RNA
cgctcttccgcgtctcaagagggaccagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45847 - RNA, 296 nt, synthetic construct
  source 1..296: mol_type = other RNA
cgctcttccgcgtctcaagagggacatccagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45848 - RNA, 296 nt, synthetic construct
  source 1..296: mol_type = other RNA
cgctcttccgcgtctcaagagggacatctcgcagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45849 - RNA, 296 nt, synthetic construct
  source 1..296: mol_type = other RNA
cgctcttccgcgtctcaagagggacatctcgcgacagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45850 - RNA, 296 nt, synthetic construct
  source 1..296: mol_type = other RNA
cgctcttccgcgtctcaagagggacatctcgcgatttcaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45851 - RNA, 296 nt, synthetic construct
  source 1..296: mol_type = other RNA
cgctcttccgcgtctcaagagggacatctcgcgatttcttcagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45852 - RNA, 296 nt, synthetic construct
  source 1..296: mol_type = other RNA
cgctcttccgcgtctcaagagggacatctcgcgatttcttgagcagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45853 - RNA, 296 nt, synthetic construct
  source 1..296: mol_type = other RNA
cgctcttccgcgtctcaagagggacatctcgcgatttcttgagtctcagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45854 - RNA, 296 nt, synthetic construct
  source 1..296: mol_type = other RNA
cgctcttccgcgtctcaagagggacatctcgcgatttcttgagtctaaccaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45855 - RNA, 296 nt, synthetic construct
  source 1..296: mol_type = other RNA
cgctcttccgcgtctcaagagggacatctcgcgatttcttgagtctaacccccagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45856 - RNA, 296 nt, synthetic construct
  source 1..296: mol_type = other RNA
cgctcttccgcgtctcaagagggacatctcgcgatttcttgagtctaaccccgtgcagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45857 - RNA, 296 nt, synthetic construct
  source 1..296: mol_type = other RNA
cgctcttccgcgtctcaagagggacatctcgcgatttcttgagtctaaccccgtgatgcaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45858 - RNA, 296 nt, synthetic construct
  source 1..296: mol_type = other RNA
cgctcttccgcgtctcaagagggacatctcgcgatttcttgagtctaaccccgtgatgattcaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45859 - RNA, 296 nt, synthetic construct
  source 1..296: mol_type = other RNA
cgctcttccgcgtctcaagagggacatctcgcgatttcttgagtctaaccccgtgatgattgaccagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45860 - RNA, 296 nt, synthetic construct
  source 1..296: mol_type = other RNA
cgctcttccgcgtctcaagagggacatctcgcgatttcttgagtctaaccccgtgatgattgacgcccaggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45861 - RNA, 296 nt, synthetic construct
  source 1..296: mol_type = other RNA
cgctcttccgcgtctcaagagggacatctcgcgatttcttgagtctaaccccgtgatgattgacgccaaacaggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45862 - RNA, 296 nt, synthetic construct
  source 1..296: mol_type = other RNA
cgctcttccgcgtctcaagagggacatctcgcgatttcttgagtctaaccccgtgatgattgacgccaaagaacagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45863 - RNA, 296 nt, synthetic construct
  source 1..296: mol_type = other RNA
cgctcttccgcgtctcaagagggacatctcgcgatttcttgagtctaaccccgtgatgattgacgccaaagaagtgcaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45864 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctcaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45865 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctcagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45866 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45867 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacaccaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45868 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggcagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45869 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45870 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtcagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45871 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttaccagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45872 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttccagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45873 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggcagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45874 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtcagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45875 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45876 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45877 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45878 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45879 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45880 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45881 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45882 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45883 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45884 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45885 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45886 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45887 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45888 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45889 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45890 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45891 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45892 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45893 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45894 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45895 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45896 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcaggagcacggcagaatagccaagttcagcaaagtgaggaccattaccaccaggtcaaactctataaagcagggcaaagaccagcatttccccgtcttcatgaacgagacgtcggaagagc

SEQ ID NO: 45897 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcagcacggcagaatagccaagttcagcaaagtgaggaccattaccaccaggtcaaactctataaagcagggcaaagaccagcatttccccgtcttcatgaacgagacgtcggaagagc

SEQ ID NO: 45898 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcagggcagaatagccaagttcagcaaagtgaggaccattaccaccaggtcaaactctataaagcagggcaaagaccagcatttccccgtcttcatgaacgagacgtcggaagagc

SEQ ID NO: 45899 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccagagaatagccaagttcagcaaagtgaggaccattaccaccaggtcaaactctataaagcagggcaaagaccagcatttccccgtcttcatgaacgagacgtcggaagagc

SEQ ID NO: 45900 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccagatagccaagttcagcaaagtgaggaccattaccaccaggtcaaactctataaagcagggcaaagaccagcatttccccgtcttcatgaacgagacgtcggaagagc

SEQ ID NO: 45901 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacaggccaagttcagcaaagtgaggaccattaccaccaggtcaaactctataaagcagggcaaagaccagcatttccccgtcttcatgaacgagacgtcggaagagc

SEQ ID NO: 45902 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacagaagttcagcaaagtgaggaccattaccaccaggtcaaactctataaagcagggcaaagaccagcatttccccgtcttcatgaacgagacgtcggaagagc

SEQ ID NO: 45903 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccagttcagcaaagtgaggaccattaccaccaggtcaaactctataaagcagggcaaagaccagcatttccccgtcttcatgaacgagacgtcggaagagc

SEQ ID NO: 45904 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcagagcaaagtgaggaccattaccaccaggtcaaactctataaagcagggcaaagaccagcatttccccgtcttcatgaacgagacgtcggaagagc

SEQ ID NO: 45905 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccagaaagtgaggaccattaccaccaggtcaaactctataaagcagggcaaagaccagcatttccccgtcttcatgaacgagacgtcggaagagc

SEQ ID NO: 45906 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccaggtgaggaccattaccaccaggtcaaactctataaagcagggcaaagaccagcatttccccgtcttcatgaacgagacgtcggaagagc

SEQ ID NO: 45907 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacagaggaccattaccaccaggtcaaactctataaagcagggcaaagaccagcatttccccgtcttcatgaacgagacgtcggaagagc

SEQ ID NO: 45908 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcagaccattaccaccaggtcaaactctataaagcagggcaaagaccagcatttccccgtcttcatgaacgagacgtcggaagagc

SEQ ID NO: 45909 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcagattaccaccaggtcaaactctataaagcagggcaaagaccagcatttccccgtcttcatgaacgagacgtcggaagagc

SEQ ID NO: 45910 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccagaccaccaggtcaaactctataaagcagggcaaagaccagcatttccccgtcttcatgaacgagacgtcggaagagc

SEQ ID NO: 45911 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcagaccaggtcaaactctataaagcagggcaaagaccagcatttccccgtcttcatgaacgagacgtcggaagagc

SEQ ID NO: 45912 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccagaggtcaaactctataaagcagggcaaagaccagcatttccccgtcttcatgaacgagacgtcggaagagc

SEQ ID NO: 45913 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccagtcaaactctataaagcagggcaaagaccagcatttccccgtcttcatgaacgagacgtcggaagagc

SEQ ID NO: 45914 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcagaactctataaagcagggcaaagaccagcatttccccgtcttcatgaacgagacgtcggaagagc

SEQ ID NO: 45915 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacagtctataaagcagggcaaagaccagcatttccccgtcttcatgaacgagacgtcggaagagc

SEQ ID NO: 45916 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccagataaagcagggcaaagaccagcatttccccgtcttcatgaacgagacgtcggaagagc

SEQ ID NO: 45917 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcagaagcagggcaaagaccagcatttccccgtcttcatgaacgagacgtcggaagagc

SEQ ID NO: 45918 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacagcagggcaaagaccagcatttccccgtcttcatgaacgagacgtcggaagagc

SEQ ID NO: 45919 - RNA, 296 nt, synthetic construct; identical to SEQ ID NO: 43873
  source 1..296: mol_type = other RNA

SEQ ID NO: 45920 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcagaaagaccagcatttccccgtcttcatgaacgagacgtcggaagagc

SEQ ID NO: 45921 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccaggaccagcatttccccgtcttcatgaacgagacgtcggaagagc

SEQ ID NO: 45922 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacagcagcatttccccgtcttcatgaacgagacgtcggaagagc

SEQ ID NO: 45923 - RNA, 296 nt, synthetic construct; identical to SEQ ID NO: 43873
  source 1..296: mol_type = other RNA

SEQ ID NO: 45924 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcagttccccgtcttcatgaacgagacgtcggaagagc

SEQ ID NO: 45925 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcagcccgtcttcatgaacgagacgtcggaagagc

SEQ ID NO: 45926 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccaggtcttcatgaacgagacgtcggaagagc

SEQ ID NO: 45927 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccagttcatgaacgagacgtcggaagagc

SEQ ID NO: 45928 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccagatgaacgagacgtcggaagagc

SEQ ID NO: 45929 - RNA, 296 nt, synthetic construct
  source 1..296: mol_type = other RNA
cgctcttccgcgtctcaagaggcacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45930 - RNA, 296 nt, synthetic construct
  source 1..296: mol_type = other RNA
cgctcttccgcgtctcaagagggaccactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45931 - RNA, 296 nt, synthetic construct
  source 1..296: mol_type = other RNA
cgctcttccgcgtctcaagagggacatccaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45932 - RNA, 296 nt, synthetic construct
  source 1..296: mol_type = other RNA
cgctcttccgcgtctcaagagggacatctcgcactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45933 - RNA, 296 nt, synthetic construct
  source 1..296: mol_type = other RNA
cgctcttccgcgtctcaagagggacatctcgcgacaccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45934 - RNA, 296 nt, synthetic construct
  source 1..296: mol_type = other RNA
cgctcttccgcgtctcaagagggacatctcgcgatttcacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45935 - RNA, 296 nt, synthetic construct
  source 1..296: mol_type = other RNA
cgctcttccgcgtctcaagagggacatctcgcgatttcttcactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45936 - RNA, 296 nt, synthetic construct
  source 1..296: mol_type = other RNA
cgctcttccgcgtctcaagagggacatctcgcgatttcttgagcacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45937 - RNA, 296 nt, synthetic construct
  source 1..296: mol_type = other RNA
cgctcttccgcgtctcaagagggacatctcgcgatttcttgagtctcaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45938 - RNA, 296 nt, synthetic construct
  source 1..296: mol_type = other RNA
cgctcttccgcgtctcaagagggacatctcgcgatttcttgagtctaaccacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45939 - RNA, 296 nt, synthetic construct
  source 1..296: mol_type = other RNA
cgctcttccgcgtctcaagagggacatctcgcgatttcttgagtctaacccccacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45940 - RNA, 296 nt, synthetic construct
  source 1..296: mol_type = other RNA
cgctcttccgcgtctcaagagggacatctcgcgatttcttgagtctaaccccgtgcacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45941 - RNA, 296 nt, synthetic construct
  source 1..296: mol_type = other RNA
cgctcttccgcgtctcaagagggacatctcgcgatttcttgagtctaaccccgtgatgcacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45942 - RNA, 296 nt, synthetic construct
  source 1..296: mol_type = other RNA
cgctcttccgcgtctcaagagggacatctcgcgatttcttgagtctaaccccgtgatgattcacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45943 - RNA, 296 nt, synthetic construct
  source 1..296: mol_type = other RNA
cgctcttccgcgtctcaagagggacatctcgcgatttcttgagtctaaccccgtgatgattgaccacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45944 - RNA, 296 nt, synthetic construct
  source 1..296: mol_type = other RNA
cgctcttccgcgtctcaagagggacatctcgcgatttcttgagtctaaccccgtgatgattgacgcccacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45945 - RNA, 296 nt, synthetic construct
  source 1..296: mol_type = other RNA
cgctcttccgcgtctcaagagggacatctcgcgatttcttgagtctaaccccgtgatgattgacgccaaacacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45946 - RNA, 296 nt, synthetic construct
  source 1..296: mol_type = other RNA
cgctcttccgcgtctcaagagggacatctcgcgatttcttgagtctaaccccgtgatgattgacgccaaagaacactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45947 - RNA, 296 nt, synthetic construct
  source 1..296: mol_type = other RNA
cgctcttccgcgtctcaagagggacatctcgcgatttcttgagtctaaccccgtgatgattgacgccaaagaagtgcacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45948 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctcacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45949 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctcaccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45950 - RNA, 296 nt, synthetic construct; identical to SEQ ID NO: 43873
  source 1..296: mol_type = other RNA

SEQ ID NO: 45951 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacaccacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45952 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggcaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45953 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45954 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtcacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45955 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttaccactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45956 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttccacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45957 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggcacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45958 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtcaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45959 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45960 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45961 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45962 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45963 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45964 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45965 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45966 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45967 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45968 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45969 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45970 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45971 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45972 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45973 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45974 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45975 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45976 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45977 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45978 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45979 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 45980 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcacgagcacggcagaatagccaagttcagcaaagtgaggaccattaccaccaggtcaaactctataaagcagggcaaagaccagcatttccccgtcttcatgaacgagacgtcggaagagc

SEQ ID NO: 45981 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcaccacggcagaatagccaagttcagcaaagtgaggaccattaccaccaggtcaaactctataaagcagggcaaagaccagcatttccccgtcttcatgaacgagacgtcggaagagc

SEQ ID NO: 45982 - RNA, 296 nt, synthetic construct; identical to SEQ ID NO: 43873
  source 1..296: mol_type = other RNA

SEQ ID NO: 45983 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccacagaatagccaagttcagcaaagtgaggaccattaccaccaggtcaaactctataaagcagggcaaagaccagcatttccccgtcttcatgaacgagacgtcggaagagc

SEQ ID NO: 45984 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccacatagccaagttcagcaaagtgaggaccattaccaccaggtcaaactctataaagcagggcaaagaccagcatttccccgtcttcatgaacgagacgtcggaagagc

SEQ ID NO: 45985 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacacgccaagttcagcaaagtgaggaccattaccaccaggtcaaactctataaagcagggcaaagaccagcatttccccgtcttcatgaacgagacgtcggaagagc

SEQ ID NO: 45986 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacacaagttcagcaaagtgaggaccattaccaccaggtcaaactctataaagcagggcaaagaccagcatttccccgtcttcatgaacgagacgtcggaagagc

SEQ ID NO: 45987 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccacttcagcaaagtgaggaccattaccaccaggtcaaactctataaagcagggcaaagaccagcatttccccgtcttcatgaacgagacgtcggaagagc

SEQ ID NO: 45988 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcacagcaaagtgaggaccattaccaccaggtcaaactctataaagcagggcaaagaccagcatttccccgtcttcatgaacgagacgtcggaagagc

SEQ ID NO: 45989 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccacaaagtgaggaccattaccaccaggtcaaactctataaagcagggcaaagaccagcatttccccgtcttcatgaacgagacgtcggaagagc

SEQ ID NO: 45990 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccacgtgaggaccattaccaccaggtcaaactctataaagcagggcaaagaccagcatttccccgtcttcatgaacgagacgtcggaagagc

SEQ ID NO: 45991 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacacaggaccattaccaccaggtcaaactctataaagcagggcaaagaccagcatttccccgtcttcatgaacgagacgtcggaagagc

SEQ ID NO: 45992 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcacaccattaccaccaggtcaaactctataaagcagggcaaagaccagcatttccccgtcttcatgaacgagacgtcggaagagc

SEQ ID NO: 45993 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcacattaccaccaggtcaaactctataaagcagggcaaagaccagcatttccccgtcttcatgaacgagacgtcggaagagc

SEQ ID NO: 45994 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccacaccaccaggtcaaactctataaagcagggcaaagaccagcatttccccgtcttcatgaacgagacgtcggaagagc

SEQ ID NO: 45995 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcacaccaggtcaaactctataaagcagggcaaagaccagcatttccccgtcttcatgaacgagacgtcggaagagc

SEQ ID NO: 45996 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccacaggtcaaactctataaagcagggcaaagaccagcatttccccgtcttcatgaacgagacgtcggaagagc

SEQ ID NO: 45997 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccactcaaactctataaagcagggcaaagaccagcatttccccgtcttcatgaacgagacgtcggaagagc

SEQ ID NO: 45998 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcacaactctataaagcagggcaaagaccagcatttccccgtcttcatgaacgagacgtcggaagagc

SEQ ID NO: 45999 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacactctataaagcagggcaaagaccagcatttccccgtcttcatgaacgagacgtcggaagagc

SEQ ID NO: 46000 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccacataaagcagggcaaagaccagcatttccccgtcttcatgaacgagacgtcggaagagc

SEQ ID NO: 46001 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcacaagcagggcaaagaccagcatttccccgtcttcatgaacgagacgtcggaagagc

SEQ ID NO: 46002 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacaccagggcaaagaccagcatttccccgtcttcatgaacgagacgtcggaagagc

SEQ ID NO: 46003 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcacggcaaagaccagcatttccccgtcttcatgaacgagacgtcggaagagc

SEQ ID NO: 46004 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcacaaagaccagcatttccccgtcttcatgaacgagacgtcggaagagc

SEQ ID NO: 46005 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccacgaccagcatttccccgtcttcatgaacgagacgtcggaagagc

SEQ ID NO: 46006 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacaccagcatttccccgtcttcatgaacgagacgtcggaagagc

SEQ ID NO: 46007 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccaccatttccccgtcttcatgaacgagacgtcggaagagc

SEQ ID NO: 46008 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcacttccccgtcttcatgaacgagacgtcggaagagc

SEQ ID NO: 46009 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcaccccgtcttcatgaacgagacgtcggaagagc

SEQ ID NO: 46010 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccacgtcttcatgaacgagacgtcggaagagc

SEQ ID NO: 46011 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccacttcatgaacgagacgtcggaagagc

SEQ ID NO: 46012 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccacatgaacgagacgtcggaagagc

SEQ ID NO: 46013 - RNA, 296 nt, synthetic construct
  source 1..296: mol_type = other RNA
cgctcttccgcgtctcaagaggctgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46014 - RNA, 296 nt, synthetic construct
  source 1..296: mol_type = other RNA
cgctcttccgcgtctcaagagggacctgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46015 - RNA, 296 nt, synthetic construct
  source 1..296: mol_type = other RNA
cgctcttccgcgtctcaagagggacatcctgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46016 - RNA, 296 nt, synthetic construct
  source 1..296: mol_type = other RNA
cgctcttccgcgtctcaagagggacatctcgctgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46017 - RNA, 296 nt, synthetic construct
  source 1..296: mol_type = other RNA
cgctcttccgcgtctcaagagggacatctcgcgactgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46018 - RNA, 296 nt, synthetic construct
  source 1..296: mol_type = other RNA
cgctcttccgcgtctcaagagggacatctcgcgatttctggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46019 - RNA, 296 nt, synthetic construct
  source 1..296: mol_type = other RNA
cgctcttccgcgtctcaagagggacatctcgcgatttcttctgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46020 - RNA, 296 nt, synthetic construct
  source 1..296: mol_type = other RNA
cgctcttccgcgtctcaagagggacatctcgcgatttcttgagctgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46021 - RNA, 296 nt, synthetic construct
  source 1..296: mol_type = other RNA
cgctcttccgcgtctcaagagggacatctcgcgatttcttgagtctctgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46022 - RNA, 296 nt, synthetic construct
  source 1..296: mol_type = other RNA
cgctcttccgcgtctcaagagggacatctcgcgatttcttgagtctaacctggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46023 - RNA, 296 nt, synthetic construct
  source 1..296: mol_type = other RNA
cgctcttccgcgtctcaagagggacatctcgcgatttcttgagtctaaccccctgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46024 - RNA, 296 nt, synthetic construct
  source 1..296: mol_type = other RNA
cgctcttccgcgtctcaagagggacatctcgcgatttcttgagtctaaccccgtgctgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46025 - RNA, 296 nt, synthetic construct
  source 1..296: mol_type = other RNA
cgctcttccgcgtctcaagagggacatctcgcgatttcttgagtctaaccccgtgatgctggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46026 - RNA, 296 nt, synthetic construct
  source 1..296: mol_type = other RNA
cgctcttccgcgtctcaagagggacatctcgcgatttcttgagtctaaccccgtgatgattctggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46027 - RNA, 296 nt, synthetic construct
  source 1..296: mol_type = other RNA
cgctcttccgcgtctcaagagggacatctcgcgatttcttgagtctaaccccgtgatgattgacctgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46028 - RNA, 296 nt, synthetic construct
  source 1..296: mol_type = other RNA
cgctcttccgcgtctcaagagggacatctcgcgatttcttgagtctaaccccgtgatgattgacgccctggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46029 - RNA, 296 nt, synthetic construct
  source 1..296: mol_type = other RNA
cgctcttccgcgtctcaagagggacatctcgcgatttcttgagtctaaccccgtgatgattgacgccaaactggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46030 - RNA, 296 nt, synthetic construct
  source 1..296: mol_type = other RNA
cgctcttccgcgtctcaagagggacatctcgcgatttcttgagtctaaccccgtgatgattgacgccaaagaactgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46031 - RNA, 296 nt, synthetic construct
  source 1..296: mol_type = other RNA
cgctcttccgcgtctcaagagggacatctcgcgatttcttgagtctaaccccgtgatgattgacgccaaagaagtgctggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46032 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctctggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46033 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctctgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46034 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcactgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46035 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacctggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46036 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggctgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46037 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccctgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46038 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtctgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46039 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacctgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46040 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcctgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46041 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggctgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46042 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtctgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46043 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46044 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttctgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46045 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctctgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46046 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcctgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46047 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgctgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46048 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacctgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46049 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggctgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46050 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctctggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46051 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgctgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46052 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcactgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46053 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccctggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46054 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactctgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46055 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgctggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46056 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatctgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46057 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatctgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46058 - RNA, 296 nt, synthetic construct; identical to SEQ ID NO: 43873
  source 1..296: mol_type = other RNA

SEQ ID NO: 46059 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgctgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46060 - RNA, 296 nt, synthetic construct; identical to SEQ ID NO: 43873
  source 1..296: mol_type = other RNA

SEQ ID NO: 46061 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgctggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46062 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaactgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46063 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagctgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46064 - RNA, 296 nt, synthetic construct; identical to SEQ ID NO: 43873
  source 1..296: mol_type = other RNA

SEQ ID NO: 46065 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgctgcacggcagaatagccaagttcagcaaagtgaggaccattaccaccaggtcaaactctataaagcagggcaaagaccagcatttccccgtcttcatgaacgagacgtcggaagagc

SEQ ID NO: 46066 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagctgggcagaatagccaagttcagcaaagtgaggaccattaccaccaggtcaaactctataaagcagggcaaagaccagcatttccccgtcttcatgaacgagacgtcggaagagc

SEQ ID NO: 46067 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacctgagaatagccaagttcagcaaagtgaggaccattaccaccaggtcaaactctataaagcagggcaaagaccagcatttccccgtcttcatgaacgagacgtcggaagagc

SEQ ID NO: 46068 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcctgatagccaagttcagcaaagtgaggaccattaccaccaggtcaaactctataaagcagggcaaagaccagcatttccccgtcttcatgaacgagacgtcggaagagc

SEQ ID NO: 46069 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagactggccaagttcagcaaagtgaggaccattaccaccaggtcaaactctataaagcagggcaaagaccagcatttccccgtcttcatgaacgagacgtcggaagagc

SEQ ID NO: 46070 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatactgaagttcagcaaagtgaggaccattaccaccaggtcaaactctataaagcagggcaaagaccagcatttccccgtcttcatgaacgagacgtcggaagagc

SEQ ID NO: 46071 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccctgttcagcaaagtgaggaccattaccaccaggtcaaactctataaagcagggcaaagaccagcatttccccgtcttcatgaacgagacgtcggaagagc

SEQ ID NO: 46072 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagctgagcaaagtgaggaccattaccaccaggtcaaactctataaagcagggcaaagaccagcatttccccgtcttcatgaacgagacgtcggaagagc

SEQ ID NO: 46073 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcctgaaagtgaggaccattaccaccaggtcaaactctataaagcagggcaaagaccagcatttccccgtcttcatgaacgagacgtcggaagagc

SEQ ID NO: 46074 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcctggtgaggaccattaccaccaggtcaaactctataaagcagggcaaagaccagcatttccccgtcttcatgaacgagacgtcggaagagc

SEQ ID NO: 46075 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaactgaggaccattaccaccaggtcaaactctataaagcagggcaaagaccagcatttccccgtcttcatgaacgagacgtcggaagagc

SEQ ID NO: 46076 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgctgaccattaccaccaggtcaaactctataaagcagggcaaagaccagcatttccccgtcttcatgaacgagacgtcggaagagc

SEQ ID NO: 46077 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggctgattaccaccaggtcaaactctataaagcagggcaaagaccagcatttccccgtcttcatgaacgagacgtcggaagagc

SEQ ID NO: 46078 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccctgaccaccaggtcaaactctataaagcagggcaaagaccagcatttccccgtcttcatgaacgagacgtcggaagagc

SEQ ID NO: 46079 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattctgaccaggtcaaactctataaagcagggcaaagaccagcatttccccgtcttcatgaacgagacgtcggaagagc

SEQ ID NO: 46080 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccctgaggtcaaactctataaagcagggcaaagaccagcatttccccgtcttcatgaacgagacgtcggaagagc

SEQ ID NO: 46081 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccctgtcaaactctataaagcagggcaaagaccagcatttccccgtcttcatgaacgagacgtcggaagagc

SEQ ID NO: 46082 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggctgaactctataaagcagggcaaagaccagcatttccccgtcttcatgaacgagacgtcggaagagc

SEQ ID NO: 46083 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcactgtctataaagcagggcaaagaccagcatttccccgtcttcatgaacgagacgtcggaagagc

SEQ ID NO: 46084 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacctgataaagcagggcaaagaccagcatttccccgtcttcatgaacgagacgtcggaagagc

SEQ ID NO: 46085 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctctgaagcagggcaaagaccagcatttccccgtcttcatgaacgagacgtcggaagagc

SEQ ID NO: 46086 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatactgcagggcaaagaccagcatttccccgtcttcatgaacgagacgtcggaagagc

SEQ ID NO: 46087 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagctgggcaaagaccagcatttccccgtcttcatgaacgagacgtcggaagagc

SEQ ID NO: 46088 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagctgaaagaccagcatttccccgtcttcatgaacgagacgtcggaagagc

SEQ ID NO: 46089 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcctggaccagcatttccccgtcttcatgaacgagacgtcggaagagc

SEQ ID NO: 46090 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaactgcagcatttccccgtcttcatgaacgagacgtcggaagagc

SEQ ID NO: 46091 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacctgcatttccccgtcttcatgaacgagacgtcggaagagc

SEQ ID NO: 46092 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagctgttccccgtcttcatgaacgagacgtcggaagagc

SEQ ID NO: 46093 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatctgcccgtcttcatgaacgagacgtcggaagagc

SEQ ID NO: 46094 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcctggtcttcatgaacgagacgtcggaagagc

SEQ ID NO: 46095 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccctgttcatgaacgagacgtcggaagagc

SEQ ID NO: 46096 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcctgatgaacgagacgtcggaagagc

SEQ ID NO: 46097 - RNA, 296 nt, synthetic construct
  source 1..296: mol_type = other RNA
cgctcttccgcgtctcaagaggctcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46098 - RNA, 296 nt, synthetic construct
  source 1..296: mol_type = other RNA
cgctcttccgcgtctcaagagggacctctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46099 - RNA, 296 nt, synthetic construct
  source 1..296: mol_type = other RNA
cgctcttccgcgtctcaagagggacatcctccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46100 - RNA, 296 nt, synthetic construct
  source 1..296: mol_type = other RNA
cgctcttccgcgtctcaagagggacatctcgctctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46101 - RNA, 296 nt, synthetic construct
  source 1..296: mol_type = other RNA
cgctcttccgcgtctcaagagggacatctcgcgactccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46102 - RNA, 296 nt, synthetic construct
  source 1..296: mol_type = other RNA
cgctcttccgcgtctcaagagggacatctcgcgatttctcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46103 - RNA, 296 nt, synthetic construct
  source 1..296: mol_type = other RNA
cgctcttccgcgtctcaagagggacatctcgcgatttcttctctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46104 - RNA, 296 nt, synthetic construct
  source 1..296: mol_type = other RNA
cgctcttccgcgtctcaagagggacatctcgcgatttcttgagctcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46105 - RNA, 296 nt, synthetic construct
  source 1..296: mol_type = other RNA
cgctcttccgcgtctcaagagggacatctcgcgatttcttgagtctctccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46106 - RNA, 296 nt, synthetic construct
  source 1..296: mol_type = other RNA
cgctcttccgcgtctcaagagggacatctcgcgatttcttgagtctaacctcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46107 - RNA, 296 nt, synthetic construct
  source 1..296: mol_type = other RNA
cgctcttccgcgtctcaagagggacatctcgcgatttcttgagtctaaccccctcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46108 - RNA, 296 nt, synthetic construct
  source 1..296: mol_type = other RNA
cgctcttccgcgtctcaagagggacatctcgcgatttcttgagtctaaccccgtgctcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46109 - RNA, 296 nt, synthetic construct
  source 1..296: mol_type = other RNA
cgctcttccgcgtctcaagagggacatctcgcgatttcttgagtctaaccccgtgatgctcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46110 - RNA, 296 nt, synthetic construct
  source 1..296: mol_type = other RNA
cgctcttccgcgtctcaagagggacatctcgcgatttcttgagtctaaccccgtgatgattctcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46111 - RNA, 296 nt, synthetic construct
  source 1..296: mol_type = other RNA
cgctcttccgcgtctcaagagggacatctcgcgatttcttgagtctaaccccgtgatgattgacctcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46112 - RNA, 296 nt, synthetic construct
  source 1..296: mol_type = other RNA
cgctcttccgcgtctcaagagggacatctcgcgatttcttgagtctaaccccgtgatgattgacgccctcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46113 - RNA, 296 nt, synthetic construct
  source 1..296: mol_type = other RNA
cgctcttccgcgtctcaagagggacatctcgcgatttcttgagtctaaccccgtgatgattgacgccaaactcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46114 - RNA, 296 nt, synthetic construct
  source 1..296: mol_type = other RNA
cgctcttccgcgtctcaagagggacatctcgcgatttcttgagtctaaccccgtgatgattgacgccaaagaactctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46115 - RNA, 296 nt, synthetic construct
  source 1..296: mol_type = other RNA
cgctcttccgcgtctcaagagggacatctcgcgatttcttgagtctaaccccgtgatgattgacgccaaagaagtgctcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46116 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctctcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46117 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctctccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46118 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcactcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46119 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacctcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46120 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggctccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46121 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccctctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46122 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtctcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46123 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacctctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46124 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcctcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46125 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggctcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46126 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtctccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46127 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacctccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46128 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttctcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46129 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctctcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46130 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcctcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46131 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgctcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46132 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacctccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46133 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggctcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46134 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctctcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46135 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgctctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46136 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcactcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46137 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccctcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46138 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactctcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46139 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgctcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46140 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatctcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46141 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatctcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46142 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46143 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgctcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46144 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46145 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgctcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46146 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaactctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46147 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagctcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46148 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctcgagcacggcagaatagccaagttcagcaaagtgaggaccattaccaccaggtcaaactctataaagcagggcaaagaccagcatttccccgtcttcatgaacgagacgtcggaagagc

SEQ ID NO: 46149 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgctccacggcagaatagccaagttcagcaaagtgaggaccattaccaccaggtcaaactctataaagcagggcaaagaccagcatttccccgtcttcatgaacgagacgtcggaagagc

SEQ ID NO: 46150 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagctcggcagaatagccaagttcagcaaagtgaggaccattaccaccaggtcaaactctataaagcagggcaaagaccagcatttccccgtcttcatgaacgagacgtcggaagagc

SEQ ID NO: 46151 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacctcagaatagccaagttcagcaaagtgaggaccattaccaccaggtcaaactctataaagcagggcaaagaccagcatttccccgtcttcatgaacgagacgtcggaagagc

SEQ ID NO: 46152 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcctcatagccaagttcagcaaagtgaggaccattaccaccaggtcaaactctataaagcagggcaaagaccagcatttccccgtcttcatgaacgagacgtcggaagagc

SEQ ID NO: 46153 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagactcgccaagttcagcaaagtgaggaccattaccaccaggtcaaactctataaagcagggcaaagaccagcatttccccgtcttcatgaacgagacgtcggaagagc

SEQ ID NO: 46154 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatactcaagttcagcaaagtgaggaccattaccaccaggtcaaactctataaagcagggcaaagaccagcatttccccgtcttcatgaacgagacgtcggaagagc

SEQ ID NO: 46155 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccctcttcagcaaagtgaggaccattaccaccaggtcaaactctataaagcagggcaaagaccagcatttccccgtcttcatgaacgagacgtcggaagagc

SEQ ID NO: 46156 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagctcagcaaagtgaggaccattaccaccaggtcaaactctataaagcagggcaaagaccagcatttccccgtcttcatgaacgagacgtcggaagagc

SEQ ID NO: 46157 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcctcaaagtgaggaccattaccaccaggtcaaactctataaagcagggcaaagaccagcatttccccgtcttcatgaacgagacgtcggaagagc

SEQ ID NO: 46158 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcctcgtgaggaccattaccaccaggtcaaactctataaagcagggcaaagaccagcatttccccgtcttcatgaacgagacgtcggaagagc

SEQ ID NO: 46159 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaactcaggaccattaccaccaggtcaaactctataaagcagggcaaagaccagcatttccccgtcttcatgaacgagacgtcggaagagc

SEQ ID NO: 46160 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgctcaccattaccaccaggtcaaactctataaagcagggcaaagaccagcatttccccgtcttcatgaacgagacgtcggaagagc

SEQ ID NO: 46161 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggctcattaccaccaggtcaaactctataaagcagggcaaagaccagcatttccccgtcttcatgaacgagacgtcggaagagc

SEQ ID NO: 46162 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccctcaccaccaggtcaaactctataaagcagggcaaagaccagcatttccccgtcttcatgaacgagacgtcggaagagc

SEQ ID NO: 46163 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattctcaccaggtcaaactctataaagcagggcaaagaccagcatttccccgtcttcatgaacgagacgtcggaagagc

SEQ ID NO: 46164 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccctcaggtcaaactctataaagcagggcaaagaccagcatttccccgtcttcatgaacgagacgtcggaagagc

SEQ ID NO: 46165 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccctctcaaactctataaagcagggcaaagaccagcatttccccgtcttcatgaacgagacgtcggaagagc

SEQ ID NO: 46166 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggctcaactctataaagcagggcaaagaccagcatttccccgtcttcatgaacgagacgtcggaagagc

SEQ ID NO: 46167 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcactctctataaagcagggcaaagaccagcatttccccgtcttcatgaacgagacgtcggaagagc

SEQ ID NO: 46168 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacctcataaagcagggcaaagaccagcatttccccgtcttcatgaacgagacgtcggaagagc

SEQ ID NO: 46169 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctctcaagcagggcaaagaccagcatttccccgtcttcatgaacgagacgtcggaagagc

SEQ ID NO: 46170 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatactccagggcaaagaccagcatttccccgtcttcatgaacgagacgtcggaagagc

SEQ ID NO: 46171 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagctcggcaaagaccagcatttccccgtcttcatgaacgagacgtcggaagagc

SEQ ID NO: 46172 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagctcaaagaccagcatttccccgtcttcatgaacgagacgtcggaagagc

SEQ ID NO: 46173 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcctcgaccagcatttccccgtcttcatgaacgagacgtcggaagagc

SEQ ID NO: 46174 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaactccagcatttccccgtcttcatgaacgagacgtcggaagagc

SEQ ID NO: 46175 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacctccatttccccgtcttcatgaacgagacgtcggaagagc

SEQ ID NO: 46176 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagctcttccccgtcttcatgaacgagacgtcggaagagc

SEQ ID NO: 46177 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatctccccgtcttcatgaacgagacgtcggaagagc

SEQ ID NO: 46178 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcctcgtcttcatgaacgagacgtcggaagagc

SEQ ID NO: 46179 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccctcttcatgaacgagacgtcggaagagc

SEQ ID NO: 46180 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcctcatgaacgagacgtcggaagagc

SEQ ID NO: 46181 - RNA, 296 nt, synthetic construct
  source 1..296: mol_type = other RNA
cgctcttccgcgtctcaagaggcggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46182 - RNA, 296 nt, synthetic construct
  source 1..296: mol_type = other RNA
cgctcttccgcgtctcaagagggaccggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46183 - RNA, 296 nt, synthetic construct
  source 1..296: mol_type = other RNA
cgctcttccgcgtctcaagagggacatccggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46184 - RNA, 296 nt, synthetic construct
  source 1..296: mol_type = other RNA
cgctcttccgcgtctcaagagggacatctcgcggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46185 - RNA, 296 nt, synthetic construct
  source 1..296: mol_type = other RNA
cgctcttccgcgtctcaagagggacatctcgcgacggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46186 - RNA, 296 nt, synthetic construct
  source 1..296: mol_type = other RNA
cgctcttccgcgtctcaagagggacatctcgcgatttcgggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46187 - RNA, 296 nt, synthetic construct
  source 1..296: mol_type = other RNA
cgctcttccgcgtctcaagagggacatctcgcgatttcttcggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46188 - RNA, 296 nt, synthetic construct
  source 1..296: mol_type = other RNA
cgctcttccgcgtctcaagagggacatctcgcgatttcttgagcggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46189 - RNA, 296 nt, synthetic construct
  source 1..296: mol_type = other RNA
cgctcttccgcgtctcaagagggacatctcgcgatttcttgagtctcggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46190 - RNA, 296 nt, synthetic construct
  source 1..296: mol_type = other RNA
cgctcttccgcgtctcaagagggacatctcgcgatttcttgagtctaaccgggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46191 - RNA, 296 nt, synthetic construct
  source 1..296: mol_type = other RNA
cgctcttccgcgtctcaagagggacatctcgcgatttcttgagtctaacccccggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46192 - RNA, 296 nt, synthetic construct
  source 1..296: mol_type = other RNA
cgctcttccgcgtctcaagagggacatctcgcgatttcttgagtctaaccccgtgcggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46193 - RNA, 296 nt, synthetic construct
  source 1..296: mol_type = other RNA
cgctcttccgcgtctcaagagggacatctcgcgatttcttgagtctaaccccgtgatgcgggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46194 - RNA, 296 nt, synthetic construct
  source 1..296: mol_type = other RNA
cgctcttccgcgtctcaagagggacatctcgcgatttcttgagtctaaccccgtgatgattcgggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46195 - RNA, 296 nt, synthetic construct
  source 1..296: mol_type = other RNA
cgctcttccgcgtctcaagagggacatctcgcgatttcttgagtctaaccccgtgatgattgaccggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46196 - RNA, 296 nt, synthetic construct
  source 1..296: mol_type = other RNA
cgctcttccgcgtctcaagagggacatctcgcgatttcttgagtctaaccccgtgatgattgacgcccgggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46197 - RNA, 296 nt, synthetic construct
  source 1..296: mol_type = other RNA
cgctcttccgcgtctcaagagggacatctcgcgatttcttgagtctaaccccgtgatgattgacgccaaacgggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46198 - RNA, 296 nt, synthetic construct
  source 1..296: mol_type = other RNA
cgctcttccgcgtctcaagagggacatctcgcgatttcttgagtctaaccccgtgatgattgacgccaaagaacggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46199 - RNA, 296 nt, synthetic construct
  source 1..296: mol_type = other RNA
cgctcttccgcgtctcaagagggacatctcgcgatttcttgagtctaaccccgtgatgattgacgccaaagaagtgcgggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46200 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctcgggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46201 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctcggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46202 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46203 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacaccgggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46204 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggcggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46205 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46206 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtcggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46207 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttaccggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46208 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttccggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46209 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggcggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46210 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtcggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46211 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46212 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46213 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46214 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46215 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46216 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46217 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46218 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcgggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46219 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46220 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46221 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccgggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46222 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46223 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcgggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46224 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46225 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46226 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcgggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46227 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46228 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46229 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcgggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46230 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46231 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46232 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcgggagcacggcagaatagccaagttcagcaaagtgaggaccattaccaccaggtcaaactctataaagcagggcaaagaccagcatttccccgtcttcatgaacgagacgtcggaagagc

SEQ ID NO: 46233 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcggcacggcagaatagccaagttcagcaaagtgaggaccattaccaccaggtcaaactctataaagcagggcaaagaccagcatttccccgtcttcatgaacgagacgtcggaagagc

SEQ ID NO: 46234 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcggggcagaatagccaagttcagcaaagtgaggaccattaccaccaggtcaaactctataaagcagggcaaagaccagcatttccccgtcttcatgaacgagacgtcggaagagc

SEQ ID NO: 46235 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccggagaatagccaagttcagcaaagtgaggaccattaccaccaggtcaaactctataaagcagggcaaagaccagcatttccccgtcttcatgaacgagacgtcggaagagc

SEQ ID NO: 46236 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccggatagccaagttcagcaaagtgaggaccattaccaccaggtcaaactctataaagcagggcaaagaccagcatttccccgtcttcatgaacgagacgtcggaagagc

SEQ ID NO: 46237 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacgggccaagttcagcaaagtgaggaccattaccaccaggtcaaactctataaagcagggcaaagaccagcatttccccgtcttcatgaacgagacgtcggaagagc

SEQ ID NO: 46238 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacggaagttcagcaaagtgaggaccattaccaccaggtcaaactctataaagcagggcaaagaccagcatttccccgtcttcatgaacgagacgtcggaagagc

SEQ ID NO: 46239 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccggttcagcaaagtgaggaccattaccaccaggtcaaactctataaagcagggcaaagaccagcatttccccgtcttcatgaacgagacgtcggaagagc

SEQ ID NO: 46240 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcggagcaaagtgaggaccattaccaccaggtcaaactctataaagcagggcaaagaccagcatttccccgtcttcatgaacgagacgtcggaagagc

SEQ ID NO: 46241 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccggaaagtgaggaccattaccaccaggtcaaactctataaagcagggcaaagaccagcatttccccgtcttcatgaacgagacgtcggaagagc

SEQ ID NO: 46242 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccgggtgaggaccattaccaccaggtcaaactctataaagcagggcaaagaccagcatttccccgtcttcatgaacgagacgtcggaagagc

SEQ ID NO: 46243 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacggaggaccattaccaccaggtcaaactctataaagcagggcaaagaccagcatttccccgtcttcatgaacgagacgtcggaagagc

SEQ ID NO: 46244 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcggaccattaccaccaggtcaaactctataaagcagggcaaagaccagcatttccccgtcttcatgaacgagacgtcggaagagc

SEQ ID NO: 46245 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcggattaccaccaggtcaaactctataaagcagggcaaagaccagcatttccccgtcttcatgaacgagacgtcggaagagc

SEQ ID NO: 46246 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccggaccaccaggtcaaactctataaagcagggcaaagaccagcatttccccgtcttcatgaacgagacgtcggaagagc

SEQ ID NO: 46247 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcggaccaggtcaaactctataaagcagggcaaagaccagcatttccccgtcttcatgaacgagacgtcggaagagc

SEQ ID NO: 46248 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccggaggtcaaactctataaagcagggcaaagaccagcatttccccgtcttcatgaacgagacgtcggaagagc

SEQ ID NO: 46249 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccggtcaaactctataaagcagggcaaagaccagcatttccccgtcttcatgaacgagacgtcggaagagc

SEQ ID NO: 46250 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcggaactctataaagcagggcaaagaccagcatttccccgtcttcatgaacgagacgtcggaagagc

SEQ ID NO: 46251 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacggtctataaagcagggcaaagaccagcatttccccgtcttcatgaacgagacgtcggaagagc

SEQ ID NO: 46252 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccggataaagcagggcaaagaccagcatttccccgtcttcatgaacgagacgtcggaagagc

SEQ ID NO: 46253 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcggaagcagggcaaagaccagcatttccccgtcttcatgaacgagacgtcggaagagc

SEQ ID NO: 46254 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacggcagggcaaagaccagcatttccccgtcttcatgaacgagacgtcggaagagc

SEQ ID NO: 46255 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcggggcaaagaccagcatttccccgtcttcatgaacgagacgtcggaagagc

SEQ ID NO: 46256 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcggaaagaccagcatttccccgtcttcatgaacgagacgtcggaagagc

SEQ ID NO: 46257 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccgggaccagcatttccccgtcttcatgaacgagacgtcggaagagc

SEQ ID NO: 46258 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacggcagcatttccccgtcttcatgaacgagacgtcggaagagc

SEQ ID NO: 46259 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccggcatttccccgtcttcatgaacgagacgtcggaagagc

SEQ ID NO: 46260 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcggttccccgtcttcatgaacgagacgtcggaagagc

SEQ ID NO: 46261 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcggcccgtcttcatgaacgagacgtcggaagagc

SEQ ID NO: 46262 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccgggtcttcatgaacgagacgtcggaagagc

SEQ ID NO: 46263 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccggttcatgaacgagacgtcggaagagc

SEQ ID NO: 46264 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccggatgaacgagacgtcggaagagc

SEQ ID NO: 46265 - RNA, 296 nt, synthetic construct
  source 1..296: mol_type = other RNA
cgctcttccgcgtctcaagaggcgcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46266 - RNA, 296 nt, synthetic construct
  source 1..296: mol_type = other RNA
cgctcttccgcgtctcaagagggaccgctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46267 - RNA, 296 nt, synthetic construct
  source 1..296: mol_type = other RNA
cgctcttccgcgtctcaagagggacatccgccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46268 - RNA, 296 nt, synthetic construct
  source 1..296: mol_type = other RNA
cgctcttccgcgtctcaagagggacatctcgcgctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46269 - RNA, 296 nt, synthetic construct
  source 1..296: mol_type = other RNA
cgctcttccgcgtctcaagagggacatctcgcgacgccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46270 - RNA, 296 nt, synthetic construct
  source 1..296: mol_type = other RNA
cgctcttccgcgtctcaagagggacatctcgcgatttcgcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46271 - RNA, 296 nt, synthetic construct
  source 1..296: mol_type = other RNA
cgctcttccgcgtctcaagagggacatctcgcgatttcttcgctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46272 - RNA, 296 nt, synthetic construct
  source 1..296: mol_type = other RNA
cgctcttccgcgtctcaagagggacatctcgcgatttcttgagcgcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46273 - RNA, 296 nt, synthetic construct
  source 1..296: mol_type = other RNA
cgctcttccgcgtctcaagagggacatctcgcgatttcttgagtctcgccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46274 - RNA, 296 nt, synthetic construct
  source 1..296: mol_type = other RNA
cgctcttccgcgtctcaagagggacatctcgcgatttcttgagtctaaccgcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46275 - RNA, 296 nt, synthetic construct
  source 1..296: mol_type = other RNA
cgctcttccgcgtctcaagagggacatctcgcgatttcttgagtctaacccccgcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46276 - RNA, 296 nt, synthetic construct
  source 1..296: mol_type = other RNA
cgctcttccgcgtctcaagagggacatctcgcgatttcttgagtctaaccccgtgcgcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46277 - RNA, 296 nt, synthetic construct
  source 1..296: mol_type = other RNA
cgctcttccgcgtctcaagagggacatctcgcgatttcttgagtctaaccccgtgatgcgcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46278 - RNA, 296 nt, synthetic construct
  source 1..296: mol_type = other RNA
cgctcttccgcgtctcaagagggacatctcgcgatttcttgagtctaaccccgtgatgattcgcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46279 - RNA, 296 nt, synthetic construct
  source 1..296: mol_type = other RNA
cgctcttccgcgtctcaagagggacatctcgcgatttcttgagtctaaccccgtgatgattgaccgcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46280 - RNA, 296 nt, synthetic construct
  source 1..296: mol_type = other RNA
cgctcttccgcgtctcaagagggacatctcgcgatttcttgagtctaaccccgtgatgattgacgcccgcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46281 - RNA, 296 nt, synthetic construct
  source 1..296: mol_type = other RNA
cgctcttccgcgtctcaagagggacatctcgcgatttcttgagtctaaccccgtgatgattgacgccaaacgcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46282 - RNA, 296 nt, synthetic construct
  source 1..296: mol_type = other RNA
cgctcttccgcgtctcaagagggacatctcgcgatttcttgagtctaaccccgtgatgattgacgccaaagaacgctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46283 - RNA, 296 nt, synthetic construct
  source 1..296: mol_type = other RNA
cgctcttccgcgtctcaagagggacatctcgcgatttcttgagtctaaccccgtgatgattgacgccaaagaagtgcgcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46284 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctcgcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46285 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctcgccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46286 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacgcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46287 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacaccgcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46288 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggcgccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46289 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46290 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtcgcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46291 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttaccgctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46292 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttccgcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46293 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggcgcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46294 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtcgccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46295 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccgccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46296 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcgcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46297 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcgcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46298 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccgcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46299 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcgcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46300 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaaccgccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46301 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcgcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46302 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcgcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46303 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgcgctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46304 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacgcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46305 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccgcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46306 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcgcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46307 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcgcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46308 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcgcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46309 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcgcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46310 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcgcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46311 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcgcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46312 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagcgccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46313 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcgcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46314 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaacgctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46315 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcgcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46316 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcgcgagcacggcagaatagccaagttcagcaaagtgaggaccattaccaccaggtcaaactctataaagcagggcaaagaccagcatttccccgtcttcatgaacgagacgtcggaagagc

SEQ ID NO: 46317 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgcgccacggcagaatagccaagttcagcaaagtgaggaccattaccaccaggtcaaactctataaagcagggcaaagaccagcatttccccgtcttcatgaacgagacgtcggaagagc

SEQ ID NO: 46318 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcgcggcagaatagccaagttcagcaaagtgaggaccattaccaccaggtcaaactctataaagcagggcaaagaccagcatttccccgtcttcatgaacgagacgtcggaagagc

SEQ ID NO: 46319 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccgcagaatagccaagttcagcaaagtgaggaccattaccaccaggtcaaactctataaagcagggcaaagaccagcatttccccgtcttcatgaacgagacgtcggaagagc

SEQ ID NO: 46320 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccgcatagccaagttcagcaaagtgaggaccattaccaccaggtcaaactctataaagcagggcaaagaccagcatttccccgtcttcatgaacgagacgtcggaagagc

SEQ ID NO: 46321 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacgcgccaagttcagcaaagtgaggaccattaccaccaggtcaaactctataaagcagggcaaagaccagcatttccccgtcttcatgaacgagacgtcggaagagc

SEQ ID NO: 46322 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacgcaagttcagcaaagtgaggaccattaccaccaggtcaaactctataaagcagggcaaagaccagcatttccccgtcttcatgaacgagacgtcggaagagc

SEQ ID NO: 46323 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccgcttcagcaaagtgaggaccattaccaccaggtcaaactctataaagcagggcaaagaccagcatttccccgtcttcatgaacgagacgtcggaagagc

SEQ ID NO: 46324 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcgcagcaaagtgaggaccattaccaccaggtcaaactctataaagcagggcaaagaccagcatttccccgtcttcatgaacgagacgtcggaagagc

SEQ ID NO: 46325 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccgcaaagtgaggaccattaccaccaggtcaaactctataaagcagggcaaagaccagcatttccccgtcttcatgaacgagacgtcggaagagc

SEQ ID NO: 46326 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccgcgtgaggaccattaccaccaggtcaaactctataaagcagggcaaagaccagcatttccccgtcttcatgaacgagacgtcggaagagc

SEQ ID NO: 46327 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacgcaggaccattaccaccaggtcaaactctataaagcagggcaaagaccagcatttccccgtcttcatgaacgagacgtcggaagagc

SEQ ID NO: 46328 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcgcaccattaccaccaggtcaaactctataaagcagggcaaagaccagcatttccccgtcttcatgaacgagacgtcggaagagc

SEQ ID NO: 46329 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcgcattaccaccaggtcaaactctataaagcagggcaaagaccagcatttccccgtcttcatgaacgagacgtcggaagagc

SEQ ID NO: 46330 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccgcaccaccaggtcaaactctataaagcagggcaaagaccagcatttccccgtcttcatgaacgagacgtcggaagagc

SEQ ID NO: 46331 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcgcaccaggtcaaactctataaagcagggcaaagaccagcatttccccgtcttcatgaacgagacgtcggaagagc

SEQ ID NO: 46332 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccgcaggtcaaactctataaagcagggcaaagaccagcatttccccgtcttcatgaacgagacgtcggaagagc

SEQ ID NO: 46333 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccacccgctcaaactctataaagcagggcaaagaccagcatttccccgtcttcatgaacgagacgtcggaagagc

SEQ ID NO: 46334 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcgcaactctataaagcagggcaaagaccagcatttccccgtcttcatgaacgagacgtcggaagagc

SEQ ID NO: 46335 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcacgctctataaagcagggcaaagaccagcatttccccgtcttcatgaacgagacgtcggaagagc

SEQ ID NO: 46336 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccgcataaagcagggcaaagaccagcatttccccgtcttcatgaacgagacgtcggaagagc

SEQ ID NO: 46337 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcgcaagcagggcaaagaccagcatttccccgtcttcatgaacgagacgtcggaagagc

SEQ ID NO: 46338 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatacgccagggcaaagaccagcatttccccgtcttcatgaacgagacgtcggaagagc

SEQ ID NO: 46339 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcgcggcaaagaccagcatttccccgtcttcatgaacgagacgtcggaagagc

SEQ ID NO: 46340 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcgcaaagaccagcatttccccgtcttcatgaacgagacgtcggaagagc

SEQ ID NO: 46341 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccgcgaccagcatttccccgtcttcatgaacgagacgtcggaagagc

SEQ ID NO: 46342 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaacgccagcatttccccgtcttcatgaacgagacgtcggaagagc

SEQ ID NO: 46343 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccgccatttccccgtcttcatgaacgagacgtcggaagagc

SEQ ID NO: 46344 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcgcttccccgtcttcatgaacgagacgtcggaagagc

SEQ ID NO: 46345 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatcgccccgtcttcatgaacgagacgtcggaagagc

SEQ ID NO: 46346 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccgcgtcttcatgaacgagacgtcggaagagc

SEQ ID NO: 46347 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccgcttcatgaacgagacgtcggaagagc

SEQ ID NO: 46348 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccgcatgaacgagacgtcggaagagc

SEQ ID NO: 46349 - RNA, 296 nt, synthetic construct
  source 1..296: mol_type = other RNA
cgctcttccgcgtctcaagaggccgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46350 - RNA, 296 nt, synthetic construct
  source 1..296: mol_type = other RNA
cgctcttccgcgtctcaagagggacccgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46351 - RNA, 296 nt, synthetic construct
  source 1..296: mol_type = other RNA
cgctcttccgcgtctcaagagggacatcccgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46352 - RNA, 296 nt, synthetic construct
  source 1..296: mol_type = other RNA
cgctcttccgcgtctcaagagggacatctcgccgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46353 - RNA, 296 nt, synthetic construct
  source 1..296: mol_type = other RNA
cgctcttccgcgtctcaagagggacatctcgcgaccgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46354 - RNA, 296 nt, synthetic construct
  source 1..296: mol_type = other RNA
cgctcttccgcgtctcaagagggacatctcgcgatttccggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46355 - RNA, 296 nt, synthetic construct
  source 1..296: mol_type = other RNA
cgctcttccgcgtctcaagagggacatctcgcgatttcttccgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46356 - RNA, 296 nt, synthetic construct
  source 1..296: mol_type = other RNA
cgctcttccgcgtctcaagagggacatctcgcgatttcttgagccgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46357 - RNA, 296 nt, synthetic construct
  source 1..296: mol_type = other RNA
cgctcttccgcgtctcaagagggacatctcgcgatttcttgagtctccgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46358 - RNA, 296 nt, synthetic construct
  source 1..296: mol_type = other RNA
cgctcttccgcgtctcaagagggacatctcgcgatttcttgagtctaacccggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46359 - RNA, 296 nt, synthetic construct
  source 1..296: mol_type = other RNA
cgctcttccgcgtctcaagagggacatctcgcgatttcttgagtctaaccccccgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46360 - RNA, 296 nt, synthetic construct
  source 1..296: mol_type = other RNA
cgctcttccgcgtctcaagagggacatctcgcgatttcttgagtctaaccccgtgccgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46361 - RNA, 296 nt, synthetic construct
  source 1..296: mol_type = other RNA
cgctcttccgcgtctcaagagggacatctcgcgatttcttgagtctaaccccgtgatgccggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46362 - RNA, 296 nt, synthetic construct
  source 1..296: mol_type = other RNA
cgctcttccgcgtctcaagagggacatctcgcgatttcttgagtctaaccccgtgatgattccggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46363 - RNA, 296 nt, synthetic construct
  source 1..296: mol_type = other RNA
cgctcttccgcgtctcaagagggacatctcgcgatttcttgagtctaaccccgtgatgattgacccgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46364 - RNA, 296 nt, synthetic construct
  source 1..296: mol_type = other RNA
cgctcttccgcgtctcaagagggacatctcgcgatttcttgagtctaaccccgtgatgattgacgccccggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46365 - RNA, 296 nt, synthetic construct
  source 1..296: mol_type = other RNA
cgctcttccgcgtctcaagagggacatctcgcgatttcttgagtctaaccccgtgatgattgacgccaaaccggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46366 - RNA, 296 nt, synthetic construct
  source 1..296: mol_type = other RNA
cgctcttccgcgtctcaagagggacatctcgcgatttcttgagtctaaccccgtgatgattgacgccaaagaaccgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46367 - RNA, 296 nt, synthetic construct
  source 1..296: mol_type = other RNA
cgctcttccgcgtctcaagagggacatctcgcgatttcttgagtctaaccccgtgatgattgacgccaaagaagtgccggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46368 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctccggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46369 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctccgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46370 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcaccgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46371 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacccggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46372 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggccgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46373 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccccgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46374 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtccgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46375 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacccgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46376 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttcccgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46377 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggccgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46378 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtccgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46379 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacccgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46380 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttccgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46381 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctccgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46382 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcccgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46383 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgccgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46384 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacccgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46385 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggccgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46386 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctccggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46387 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgccgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46388 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaccgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46389 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccccggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46390 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactccgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46391 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgccggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46392 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatccgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46393 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatccgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46394 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagccggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46395 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgccgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46396 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagccgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46397 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgccggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46398 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaccgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46399 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagccgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46400 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtccggagcacggcagaatagccaagttcagcaaagtgaggaccattaccaccaggtcaaactctataaagcagggcaaagaccagcatttccccgtcttcatgaacgagacgtcggaagagc

SEQ ID NO: 46401 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgccgcacggcagaatagccaagttcagcaaagtgaggaccattaccaccaggtcaaactctataaagcagggcaaagaccagcatttccccgtcttcatgaacgagacgtcggaagagc

SEQ ID NO: 46402 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagccgggcagaatagccaagttcagcaaagtgaggaccattaccaccaggtcaaactctataaagcagggcaaagaccagcatttccccgtcttcatgaacgagacgtcggaagagc

SEQ ID NO: 46403 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacccgagaatagccaagttcagcaaagtgaggaccattaccaccaggtcaaactctataaagcagggcaaagaccagcatttccccgtcttcatgaacgagacgtcggaagagc

SEQ ID NO: 46404 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcccgatagccaagttcagcaaagtgaggaccattaccaccaggtcaaactctataaagcagggcaaagaccagcatttccccgtcttcatgaacgagacgtcggaagagc

SEQ ID NO: 46405 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaccggccaagttcagcaaagtgaggaccattaccaccaggtcaaactctataaagcagggcaaagaccagcatttccccgtcttcatgaacgagacgtcggaagagc

SEQ ID NO: 46406 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataccgaagttcagcaaagtgaggaccattaccaccaggtcaaactctataaagcagggcaaagaccagcatttccccgtcttcatgaacgagacgtcggaagagc

SEQ ID NO: 46407 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccccgttcagcaaagtgaggaccattaccaccaggtcaaactctataaagcagggcaaagaccagcatttccccgtcttcatgaacgagacgtcggaagagc

SEQ ID NO: 46408 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagccgagcaaagtgaggaccattaccaccaggtcaaactctataaagcagggcaaagaccagcatttccccgtcttcatgaacgagacgtcggaagagc

SEQ ID NO: 46409 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcccgaaagtgaggaccattaccaccaggtcaaactctataaagcagggcaaagaccagcatttccccgtcttcatgaacgagacgtcggaagagc

SEQ ID NO: 46410 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcccggtgaggaccattaccaccaggtcaaactctataaagcagggcaaagaccagcatttccccgtcttcatgaacgagacgtcggaagagc

SEQ ID NO: 46411 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaccgaggaccattaccaccaggtcaaactctataaagcagggcaaagaccagcatttccccgtcttcatgaacgagacgtcggaagagc

SEQ ID NO: 46412 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgccgaccattaccaccaggtcaaactctataaagcagggcaaagaccagcatttccccgtcttcatgaacgagacgtcggaagagc

SEQ ID NO: 46413 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggccgattaccaccaggtcaaactctataaagcagggcaaagaccagcatttccccgtcttcatgaacgagacgtcggaagagc

SEQ ID NO: 46414 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccccgaccaccaggtcaaactctataaagcagggcaaagaccagcatttccccgtcttcatgaacgagacgtcggaagagc

SEQ ID NO: 46415 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattccgaccaggtcaaactctataaagcagggcaaagaccagcatttccccgtcttcatgaacgagacgtcggaagagc

SEQ ID NO: 46416 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccccgaggtcaaactctataaagcagggcaaagaccagcatttccccgtcttcatgaacgagacgtcggaagagc

SEQ ID NO: 46417 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccccgtcaaactctataaagcagggcaaagaccagcatttccccgtcttcatgaacgagacgtcggaagagc

SEQ ID NO: 46418 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggccgaactctataaagcagggcaaagaccagcatttccccgtcttcatgaacgagacgtcggaagagc

SEQ ID NO: 46419 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaccgtctataaagcagggcaaagaccagcatttccccgtcttcatgaacgagacgtcggaagagc

SEQ ID NO: 46420 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacccgataaagcagggcaaagaccagcatttccccgtcttcatgaacgagacgtcggaagagc

SEQ ID NO: 46421 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctccgaagcagggcaaagaccagcatttccccgtcttcatgaacgagacgtcggaagagc

SEQ ID NO: 46422 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataccgcagggcaaagaccagcatttccccgtcttcatgaacgagacgtcggaagagc

SEQ ID NO: 46423 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagccgggcaaagaccagcatttccccgtcttcatgaacgagacgtcggaagagc

SEQ ID NO: 46424 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagccgaaagaccagcatttccccgtcttcatgaacgagacgtcggaagagc

SEQ ID NO: 46425 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcccggaccagcatttccccgtcttcatgaacgagacgtcggaagagc

SEQ ID NO: 46426 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaccgcagcatttccccgtcttcatgaacgagacgtcggaagagc

SEQ ID NO: 46427 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacccgcatttccccgtcttcatgaacgagacgtcggaagagc

SEQ ID NO: 46428 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagccgttccccgtcttcatgaacgagacgtcggaagagc

SEQ ID NO: 46429 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatccgcccgtcttcatgaacgagacgtcggaagagc

SEQ ID NO: 46430 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccggtcttcatgaacgagacgtcggaagagc

SEQ ID NO: 46431 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccccgttcatgaacgagacgtcggaagagc

SEQ ID NO: 46432 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcccgatgaacgagacgtcggaagagc

SEQ ID NO: 46433 - RNA, 296 nt, synthetic construct
  source 1..296: mol_type = other RNA
cgctcttccgcgtctcaagaggcccatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46434 - RNA, 296 nt, synthetic construct
  source 1..296: mol_type = other RNA
cgctcttccgcgtctcaagagggacccctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46435 - RNA, 296 nt, synthetic construct
  source 1..296: mol_type = other RNA
cgctcttccgcgtctcaagagggacatcccccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46436 - RNA, 296 nt, synthetic construct
  source 1..296: mol_type = other RNA
cgctcttccgcgtctcaagagggacatctcgccctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46437 - RNA, 296 nt, synthetic construct
  source 1..296: mol_type = other RNA
cgctcttccgcgtctcaagagggacatctcgcgaccccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46438 - RNA, 296 nt, synthetic construct
  source 1..296: mol_type = other RNA
cgctcttccgcgtctcaagagggacatctcgcgatttcccgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46439 - RNA, 296 nt, synthetic construct
  source 1..296: mol_type = other RNA
cgctcttccgcgtctcaagagggacatctcgcgatttcttccctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46440 - RNA, 296 nt, synthetic construct
  source 1..296: mol_type = other RNA
cgctcttccgcgtctcaagagggacatctcgcgatttcttgagcccaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46441 - RNA, 296 nt, synthetic construct
  source 1..296: mol_type = other RNA
cgctcttccgcgtctcaagagggacatctcgcgatttcttgagtctccccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46442 - RNA, 296 nt, synthetic construct; identical to SEQ ID NO: 43873
  source 1..296: mol_type = other RNA

SEQ ID NO: 46443 - RNA, 296 nt, synthetic construct
  source 1..296: mol_type = other RNA
cgctcttccgcgtctcaagagggacatctcgcgatttcttgagtctaacccccccatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46444 - RNA, 296 nt, synthetic construct
  source 1..296: mol_type = other RNA
cgctcttccgcgtctcaagagggacatctcgcgatttcttgagtctaaccccgtgcccattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46445 - RNA, 296 nt, synthetic construct
  source 1..296: mol_type = other RNA
cgctcttccgcgtctcaagagggacatctcgcgatttcttgagtctaaccccgtgatgcccgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46446 - RNA, 296 nt, synthetic construct
  source 1..296: mol_type = other RNA
cgctcttccgcgtctcaagagggacatctcgcgatttcttgagtctaaccccgtgatgattcccgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46447 - RNA, 296 nt, synthetic construct
  source 1..296: mol_type = other RNA
cgctcttccgcgtctcaagagggacatctcgcgatttcttgagtctaaccccgtgatgattgaccccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46448 - RNA, 296 nt, synthetic construct
  source 1..296: mol_type = other RNA
cgctcttccgcgtctcaagagggacatctcgcgatttcttgagtctaaccccgtgatgattgacgcccccgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46449 - RNA, 296 nt, synthetic construct
  source 1..296: mol_type = other RNA
cgctcttccgcgtctcaagagggacatctcgcgatttcttgagtctaaccccgtgatgattgacgccaaacccgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46450 - RNA, 296 nt, synthetic construct
  source 1..296: mol_type = other RNA
cgctcttccgcgtctcaagagggacatctcgcgatttcttgagtctaaccccgtgatgattgacgccaaagaaccctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46451 - RNA, 296 nt, synthetic construct
  source 1..296: mol_type = other RNA
cgctcttccgcgtctcaagagggacatctcgcgatttcttgagtctaaccccgtgatgattgacgccaaagaagtgcccgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46452 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctcccgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46453 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctccccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46454 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacccagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46455 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacaccccgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46456 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacaggccccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46457 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggccccctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46458 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgtcccttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46459 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacccctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46460 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttccccggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46461 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggcccaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46462 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtccccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46463 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaacccccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46464 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcccggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46465 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctcccatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46466 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggccccaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46467 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgcccaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46468 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacccccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46469 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcccttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46470 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctcccgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46471 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgccctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46472 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcacccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46473 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatcccccgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46474 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactcccaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46475 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgcccgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46476 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatcccaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46477 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatcccctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46478 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagcccgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46479 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgcccctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46480 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagccccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46481 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcccgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46482 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaccctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46483 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagcccctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46484 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtcccgagcacggcagaatagccaagttcagcaaagtgaggaccattaccaccaggtcaaactctataaagcagggcaaagaccagcatttccccgtcttcatgaacgagacgtcggaagagc

SEQ ID NO: 46485 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgccccacggcagaatagccaagttcagcaaagtgaggaccattaccaccaggtcaaactctataaagcagggcaaagaccagcatttccccgtcttcatgaacgagacgtcggaagagc

SEQ ID NO: 46486 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcccggcagaatagccaagttcagcaaagtgaggaccattaccaccaggtcaaactctataaagcagggcaaagaccagcatttccccgtcttcatgaacgagacgtcggaagagc

SEQ ID NO: 46487 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcaccccagaatagccaagttcagcaaagtgaggaccattaccaccaggtcaaactctataaagcagggcaaagaccagcatttccccgtcttcatgaacgagacgtcggaagagc

SEQ ID NO: 46488 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggccccatagccaagttcagcaaagtgaggaccattaccaccaggtcaaactctataaagcagggcaaagaccagcatttccccgtcttcatgaacgagacgtcggaagagc

SEQ ID NO: 46489 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagacccgccaagttcagcaaagtgaggaccattaccaccaggtcaaactctataaagcagggcaaagaccagcatttccccgtcttcatgaacgagacgtcggaagagc

SEQ ID NO: 46490 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatacccaagttcagcaaagtgaggaccattaccaccaggtcaaactctataaagcagggcaaagaccagcatttccccgtcttcatgaacgagacgtcggaagagc

SEQ ID NO: 46491 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagcccccttcagcaaagtgaggaccattaccaccaggtcaaactctataaagcagggcaaagaccagcatttccccgtcttcatgaacgagacgtcggaagagc

SEQ ID NO: 46492 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagcccagcaaagtgaggaccattaccaccaggtcaaactctataaagcagggcaaagaccagcatttccccgtcttcatgaacgagacgtcggaagagc

SEQ ID NO: 46493 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttccccaaagtgaggaccattaccaccaggtcaaactctataaagcagggcaaagaccagcatttccccgtcttcatgaacgagacgtcggaagagc

SEQ ID NO: 46494 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagccccgtgaggaccattaccaccaggtcaaactctataaagcagggcaaagaccagcatttccccgtcttcatgaacgagacgtcggaagagc

SEQ ID NO: 46495 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaacccaggaccattaccaccaggtcaaactctataaagcagggcaaagaccagcatttccccgtcttcatgaacgagacgtcggaagagc

SEQ ID NO: 46496 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgcccaccattaccaccaggtcaaactctataaagcagggcaaagaccagcatttccccgtcttcatgaacgagacgtcggaagagc

SEQ ID NO: 46497 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggcccattaccaccaggtcaaactctataaagcagggcaaagaccagcatttccccgtcttcatgaacgagacgtcggaagagc

SEQ ID NO: 46498 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggacccccaccaccaggtcaaactctataaagcagggcaaagaccagcatttccccgtcttcatgaacgagacgtcggaagagc

SEQ ID NO: 46499 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattcccaccaggtcaaactctataaagcagggcaaagaccagcatttccccgtcttcatgaacgagacgtcggaagagc

SEQ ID NO: 46500 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattacccccaggtcaaactctataaagcagggcaaagaccagcatttccccgtcttcatgaacgagacgtcggaagagc

SEQ ID NO: 46501 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccccctcaaactctataaagcagggcaaagaccagcatttccccgtcttcatgaacgagacgtcggaagagc

SEQ ID NO: 46502 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggcccaactctataaagcagggcaaagaccagcatttccccgtcttcatgaacgagacgtcggaagagc

SEQ ID NO: 46503 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaccctctataaagcagggcaaagaccagcatttccccgtcttcatgaacgagacgtcggaagagc

SEQ ID NO: 46504 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaaccccataaagcagggcaaagaccagcatttccccgtcttcatgaacgagacgtcggaagagc

SEQ ID NO: 46505 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctcccaagcagggcaaagaccagcatttccccgtcttcatgaacgagacgtcggaagagc

SEQ ID NO: 46506 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataccccagggcaaagaccagcatttccccgtcttcatgaacgagacgtcggaagagc

SEQ ID NO: 46507 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcccggcaaagaccagcatttccccgtcttcatgaacgagacgtcggaagagc

SEQ ID NO: 46508 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagcccaaagaccagcatttccccgtcttcatgaacgagacgtcggaagagc

SEQ ID NO: 46509 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggccccgaccagcatttccccgtcttcatgaacgagacgtcggaagagc

SEQ ID NO: 46510 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaccccagcatttccccgtcttcatgaacgagacgtcggaagagc

SEQ ID NO: 46511 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacccccatttccccgtcttcatgaacgagacgtcggaagagc

SEQ ID NO: 46512 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcccttccccgtcttcatgaacgagacgtcggaagagc

SEQ ID NO: 46513 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatccccccgtcttcatgaacgagacgtcggaagagc

SEQ ID NO: 46514 - RNA, 296 nt, synthetic construct; identical to SEQ ID NO: 43873
  source 1..296: mol_type = other RNA

SEQ ID NO: 46515 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcccccccttcatgaacgagacgtcggaagagc

SEQ ID NO: 46516 - RNA, 296 nt, synthetic construct
  source 1..296: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtccccatgaacgagacgtcggaagagc

SEQ ID NO: 46517 - RNA, 299 nt, synthetic construct
  source 1..299: mol_type = other RNA
cgctcttccgcgtctcaagagggacaagatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46518 - RNA, 299 nt, synthetic construct
  source 1..299: mol_type = other RNA
cgctcttccgcgtctcaagagggacatcaagtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46519 - RNA, 299 nt, synthetic construct
  source 1..299: mol_type = other RNA
cgctcttccgcgtctcaagagggacatctcgaagcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46520 - RNA, 299 nt, synthetic construct
  source 1..299: mol_type = other RNA
cgctcttccgcgtctcaagagggacatctcgcgaaagtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46521 - RNA, 299 nt, synthetic construct
  source 1..299: mol_type = other RNA
cgctcttccgcgtctcaagagggacatctcgcgatttaagcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46522 - RNA, 299 nt, synthetic construct
  source 1..299: mol_type = other RNA
cgctcttccgcgtctcaagagggacatctcgcgatttcttaaggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46523 - RNA, 299 nt, synthetic construct
  source 1..299: mol_type = other RNA
cgctcttccgcgtctcaagagggacatctcgcgatttcttgagaagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46524 - RNA, 299 nt, synthetic construct
  source 1..299: mol_type = other RNA
cgctcttccgcgtctcaagagggacatctcgcgatttcttgagtctaagaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46525 - RNA, 299 nt, synthetic construct
  source 1..299: mol_type = other RNA
cgctcttccgcgtctcaagagggacatctcgcgatttcttgagtctaacaagcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46526 - RNA, 299 nt, synthetic construct
  source 1..299: mol_type = other RNA
cgctcttccgcgtctcaagagggacatctcgcgatttcttgagtctaaccccaaggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46527 - RNA, 299 nt, synthetic construct
  source 1..299: mol_type = other RNA
cgctcttccgcgtctcaagagggacatctcgcgatttcttgagtctaaccccgtgaagatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46528 - RNA, 299 nt, synthetic construct
  source 1..299: mol_type = other RNA
cgctcttccgcgtctcaagagggacatctcgcgatttcttgagtctaaccccgtgatgaagattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46529 - RNA, 299 nt, synthetic construct
  source 1..299: mol_type = other RNA
cgctcttccgcgtctcaagagggacatctcgcgatttcttgagtctaaccccgtgatgattaaggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46530 - RNA, 299 nt, synthetic construct
  source 1..299: mol_type = other RNA
cgctcttccgcgtctcaagagggacatctcgcgatttcttgagtctaaccccgtgatgattgacaaggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46531 - RNA, 299 nt, synthetic construct
  source 1..299: mol_type = other RNA
cgctcttccgcgtctcaagagggacatctcgcgatttcttgagtctaaccccgtgatgattgacgccaagaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46532 - RNA, 299 nt, synthetic construct
  source 1..299: mol_type = other RNA
cgctcttccgcgtctcaagagggacatctcgcgatttcttgagtctaaccccgtgatgattgacgccaaaaaggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46533 - RNA, 299 nt, synthetic construct
  source 1..299: mol_type = other RNA
cgctcttccgcgtctcaagagggacatctcgcgatttcttgagtctaaccccgtgatgattgacgccaaagaaaaggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46534 - RNA, 299 nt, synthetic construct
  source 1..299: mol_type = other RNA
cgctcttccgcgtctcaagagggacatctcgcgatttcttgagtctaaccccgtgatgattgacgccaaagaagtgaagtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46535 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctaaggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46536 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctaaggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46537 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaaagcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46538 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaagagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46539 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggaaggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46540 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccaagcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46541 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtaagtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46542 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacaagttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46543 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcaagtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46544 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggaagggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46545 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaagaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46546 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacaagcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46547 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttaagcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46548 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaagggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46549 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaagatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46550 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaagaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46551 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaagaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46552 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggaagcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46553 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctaagttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46554 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgaaggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46555 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaaagtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46556 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccaagactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46557 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaaggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46558 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaagaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46559 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataaggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46560 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46561 - RNA, 299 nt, synthetic construct; identical to SEQ ID NO: 46560
  source 1..299: mol_type = other RNA

SEQ ID NO: 46562 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgaaggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46563 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagaagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46564 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgaagcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46565 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaaaggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46566 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagaagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46567 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtaagctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46568 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgaaggagcacggcagaatagccaagttcagcaaagtgaggaccattaccaccaggtcaaactctataaagcagggcaaagaccagcatttccccgtcttcatgaacgagacgtcggaagagc

SEQ ID NO: 46569 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagaagcacggcagaatagccaagttcagcaaagtgaggaccattaccaccaggtcaaactctataaagcagggcaaagaccagcatttccccgtcttcatgaacgagacgtcggaagagc

SEQ ID NO: 46570 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaagggcagaatagccaagttcagcaaagtgaggaccattaccaccaggtcaaactctataaagcagggcaaagaccagcatttccccgtcttcatgaacgagacgtcggaagagc

SEQ ID NO: 46571 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaagagaatagccaagttcagcaaagtgaggaccattaccaccaggtcaaactctataaagcagggcaaagaccagcatttccccgtcttcatgaacgagacgtcggaagagc

SEQ ID NO: 46572 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaaagatagccaagttcagcaaagtgaggaccattaccaccaggtcaaactctataaagcagggcaaagaccagcatttccccgtcttcatgaacgagacgtcggaagagc

SEQ ID NO: 46573 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaaggccaagttcagcaaagtgaggaccattaccaccaggtcaaactctataaagcagggcaaagaccagcatttccccgtcttcatgaacgagacgtcggaagagc

SEQ ID NO: 46574 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaagttcagcaaagtgaggaccattaccaccaggtcaaactctataaagcagggcaaagaccagcatttccccgtcttcatgaacgagacgtcggaagagc

SEQ ID NO: 46575 - RNA, 299 nt, synthetic construct; identical to SEQ ID NO: 46574
  source 1..299: mol_type = other RNA

SEQ ID NO: 46576 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaagagcaaagtgaggaccattaccaccaggtcaaactctataaagcagggcaaagaccagcatttccccgtcttcatgaacgagacgtcggaagagc

SEQ ID NO: 46577 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaagaaagtgaggaccattaccaccaggtcaaactctataaagcagggcaaagaccagcatttccccgtcttcatgaacgagacgtcggaagagc

SEQ ID NO: 46578 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaaggtgaggaccattaccaccaggtcaaactctataaagcagggcaaagaccagcatttccccgtcttcatgaacgagacgtcggaagagc

SEQ ID NO: 46579 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaagaggaccattaccaccaggtcaaactctataaagcagggcaaagaccagcatttccccgtcttcatgaacgagacgtcggaagagc

SEQ ID NO: 46580 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaagaccattaccaccaggtcaaactctataaagcagggcaaagaccagcatttccccgtcttcatgaacgagacgtcggaagagc

SEQ ID NO: 46581 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaagattaccaccaggtcaaactctataaagcagggcaaagaccagcatttccccgtcttcatgaacgagacgtcggaagagc

SEQ ID NO: 46582 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaagaccaccaggtcaaactctataaagcagggcaaagaccagcatttccccgtcttcatgaacgagacgtcggaagagc

SEQ ID NO: 46583 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaagaccaggtcaaactctataaagcagggcaaagaccagcatttccccgtcttcatgaacgagacgtcggaagagc

SEQ ID NO: 46584 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaagaggtcaaactctataaagcagggcaaagaccagcatttccccgtcttcatgaacgagacgtcggaagagc

SEQ ID NO: 46585 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaagtcaaactctataaagcagggcaaagaccagcatttccccgtcttcatgaacgagacgtcggaagagc

SEQ ID NO: 46586 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaagaactctataaagcagggcaaagaccagcatttccccgtcttcatgaacgagacgtcggaagagc

SEQ ID NO: 46587 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacaagtctataaagcagggcaaagaccagcatttccccgtcttcatgaacgagacgtcggaagagc

SEQ ID NO: 46588 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaagataaagcagggcaaagaccagcatttccccgtcttcatgaacgagacgtcggaagagc

SEQ ID NO: 46589 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagaagcagggcaaagaccagcatttccccgtcttcatgaacgagacgtcggaagagc

SEQ ID NO: 46590 - RNA, 299 nt, synthetic construct; identical to SEQ ID NO: 46589
  source 1..299: mol_type = other RNA

SEQ ID NO: 46591 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaagggcaaagaccagcatttccccgtcttcatgaacgagacgtcggaagagc

SEQ ID NO: 46592 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaagaaagaccagcatttccccgtcttcatgaacgagacgtcggaagagc

SEQ ID NO: 46593 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaaaggaccagcatttccccgtcttcatgaacgagacgtcggaagagc

SEQ ID NO: 46594 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacaagcagcatttccccgtcttcatgaacgagacgtcggaagagc

SEQ ID NO: 46595 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagaagcatttccccgtcttcatgaacgagacgtcggaagagc

SEQ ID NO: 46596 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcataagttccccgtcttcatgaacgagacgtcggaagagc

SEQ ID NO: 46597 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcaagcccgtcttcatgaacgagacgtcggaagagc

SEQ ID NO: 46598 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccaaggtcttcatgaacgagacgtcggaagagc

SEQ ID NO: 46599 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaagttcatgaacgagacgtcggaagagc

SEQ ID NO: 46600 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcaagatgaacgagacgtcggaagagc

SEQ ID NO: 46601 - RNA, 299 nt, synthetic construct
  source 1..299: mol_type = other RNA
cgctcttccgcgtctcaagagggacaacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46602 - RNA, 299 nt, synthetic construct
  source 1..299: mol_type = other RNA
cgctcttccgcgtctcaagagggacatcaactcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46603 - RNA, 299 nt, synthetic construct
  source 1..299: mol_type = other RNA
cgctcttccgcgtctcaagagggacatctcgaaccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46604 - RNA, 299 nt, synthetic construct
  source 1..299: mol_type = other RNA
cgctcttccgcgtctcaagagggacatctcgcgaaactttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46605 - RNA, 299 nt, synthetic construct
  source 1..299: mol_type = other RNA
cgctcttccgcgtctcaagagggacatctcgcgatttaaccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46606 - RNA, 299 nt, synthetic construct
  source 1..299: mol_type = other RNA
cgctcttccgcgtctcaagagggacatctcgcgatttcttaacgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46607 - RNA, 299 nt, synthetic construct
  source 1..299: mol_type = other RNA
cgctcttccgcgtctcaagagggacatctcgcgatttcttgagaactctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46608 - RNA, 299 nt, synthetic construct
  source 1..299: mol_type = other RNA
cgctcttccgcgtctcaagagggacatctcgcgatttcttgagtctaacaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46609 - RNA, 299 nt, synthetic construct; identical to SEQ ID NO: 46608
  source 1..299: mol_type = other RNA

SEQ ID NO: 46610 - RNA, 299 nt, synthetic construct
  source 1..299: mol_type = other RNA
cgctcttccgcgtctcaagagggacatctcgcgatttcttgagtctaaccccaacgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46611 - RNA, 299 nt, synthetic construct
  source 1..299: mol_type = other RNA
cgctcttccgcgtctcaagagggacatctcgcgatttcttgagtctaaccccgtgaacatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46612 - RNA, 299 nt, synthetic construct
  source 1..299: mol_type = other RNA
cgctcttccgcgtctcaagagggacatctcgcgatttcttgagtctaaccccgtgatgaacattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46613 - RNA, 299 nt, synthetic construct
  source 1..299: mol_type = other RNA
cgctcttccgcgtctcaagagggacatctcgcgatttcttgagtctaaccccgtgatgattaacgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46614 - RNA, 299 nt, synthetic construct
  source 1..299: mol_type = other RNA
cgctcttccgcgtctcaagagggacatctcgcgatttcttgagtctaaccccgtgatgattgacaacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46615 - RNA, 299 nt, synthetic construct
  source 1..299: mol_type = other RNA
cgctcttccgcgtctcaagagggacatctcgcgatttcttgagtctaaccccgtgatgattgacgccaacaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46616 - RNA, 299 nt, synthetic construct
  source 1..299: mol_type = other RNA
cgctcttccgcgtctcaagagggacatctcgcgatttcttgagtctaaccccgtgatgattgacgccaaaaacgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46617 - RNA, 299 nt, synthetic construct
  source 1..299: mol_type = other RNA
cgctcttccgcgtctcaagagggacatctcgcgatttcttgagtctaaccccgtgatgattgacgccaaagaaaacgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46618 - RNA, 299 nt, synthetic construct
  source 1..299: mol_type = other RNA
cgctcttccgcgtctcaagagggacatctcgcgatttcttgagtctaaccccgtgatgattgacgccaaagaagtgaactctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46619 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctaacgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46620 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctaacgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46621 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaaaccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46622 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46623 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggaacgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46624 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccaaccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46625 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtaactacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46626 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacaacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46627 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcaactggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46628 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggaacggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46629 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46630 - RNA, 299 nt, synthetic construct; identical to SEQ ID NO: 46629
  source 1..299: mol_type = other RNA

SEQ ID NO: 46631 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttaaccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46632 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaacggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46633 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaacatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46634 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46635 - RNA, 299 nt, synthetic construct; identical to SEQ ID NO: 46634
  source 1..299: mol_type = other RNA

SEQ ID NO: 46636 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggaaccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46637 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctaacttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46638 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgaacgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46639 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaaactccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46640 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccaacactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46641 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactaacgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46642 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaacaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46643 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaataacgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46644 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataacaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46645 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagaacctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46646 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgaacgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46647 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagaacctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46648 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgaaccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46649 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaaacgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46650 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagaactgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46651 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtaacctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46652 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgaacgagcacggcagaatagccaagttcagcaaagtgaggaccattaccaccaggtcaaactctataaagcagggcaaagaccagcatttccccgtcttcatgaacgagacgtcggaagagc

SEQ ID NO: 46653 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagaaccacggcagaatagccaagttcagcaaagtgaggaccattaccaccaggtcaaactctataaagcagggcaaagaccagcatttccccgtcttcatgaacgagacgtcggaagagc

SEQ ID NO: 46654 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaacggcagaatagccaagttcagcaaagtgaggaccattaccaccaggtcaaactctataaagcagggcaaagaccagcatttccccgtcttcatgaacgagacgtcggaagagc

SEQ ID NO: 46655 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaacagaatagccaagttcagcaaagtgaggaccattaccaccaggtcaaactctataaagcagggcaaagaccagcatttccccgtcttcatgaacgagacgtcggaagagc

SEQ ID NO: 46656 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaaacatagccaagttcagcaaagtgaggaccattaccaccaggtcaaactctataaagcagggcaaagaccagcatttccccgtcttcatgaacgagacgtcggaagagc

SEQ ID NO: 46657 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataaacgccaagttcagcaaagtgaggaccattaccaccaggtcaaactctataaagcagggcaaagaccagcatttccccgtcttcatgaacgagacgtcggaagagc

SEQ ID NO: 46658 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaacaagttcagcaaagtgaggaccattaccaccaggtcaaactctataaagcagggcaaagaccagcatttccccgtcttcatgaacgagacgtcggaagagc

SEQ ID NO: 46659 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaacttcagcaaagtgaggaccattaccaccaggtcaaactctataaagcagggcaaagaccagcatttccccgtcttcatgaacgagacgtcggaagagc

SEQ ID NO: 46660 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaacagcaaagtgaggaccattaccaccaggtcaaactctataaagcagggcaaagaccagcatttccccgtcttcatgaacgagacgtcggaagagc

SEQ ID NO: 46661 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaacaaagtgaggaccattaccaccaggtcaaactctataaagcagggcaaagaccagcatttccccgtcttcatgaacgagacgtcggaagagc

SEQ ID NO: 46662 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaaacgtgaggaccattaccaccaggtcaaactctataaagcagggcaaagaccagcatttccccgtcttcatgaacgagacgtcggaagagc

SEQ ID NO: 46663 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaacaggaccattaccaccaggtcaaactctataaagcagggcaaagaccagcatttccccgtcttcatgaacgagacgtcggaagagc

SEQ ID NO: 46664 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaacaccattaccaccaggtcaaactctataaagcagggcaaagaccagcatttccccgtcttcatgaacgagacgtcggaagagc

SEQ ID NO: 46665 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaacattaccaccaggtcaaactctataaagcagggcaaagaccagcatttccccgtcttcatgaacgagacgtcggaagagc

SEQ ID NO: 46666 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaacaccaccaggtcaaactctataaagcagggcaaagaccagcatttccccgtcttcatgaacgagacgtcggaagagc

SEQ ID NO: 46667 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaacaccaggtcaaactctataaagcagggcaaagaccagcatttccccgtcttcatgaacgagacgtcggaagagc

SEQ ID NO: 46668 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaacaggtcaaactctataaagcagggcaaagaccagcatttccccgtcttcatgaacgagacgtcggaagagc

SEQ ID NO: 46669 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaactcaaactctataaagcagggcaaagaccagcatttccccgtcttcatgaacgagacgtcggaagagc

SEQ ID NO: 46670 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacaactctataaagcagggcaaagaccagcatttccccgtcttcatgaacgagacgtcggaagagc

SEQ ID NO: 46671 - RNA, 299 nt, synthetic construct; identical to SEQ ID NO: 46670
  source 1..299: mol_type = other RNA

SEQ ID NO: 46672 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaacataaagcagggcaaagaccagcatttccccgtcttcatgaacgagacgtcggaagagc

SEQ ID NO: 46673 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaacaagcagggcaaagaccagcatttccccgtcttcatgaacgagacgtcggaagagc

SEQ ID NO: 46674 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagaaccagggcaaagaccagcatttccccgtcttcatgaacgagacgtcggaagagc

SEQ ID NO: 46675 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaacggcaaagaccagcatttccccgtcttcatgaacgagacgtcggaagagc

SEQ ID NO: 46676 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaacaaagaccagcatttccccgtcttcatgaacgagacgtcggaagagc

SEQ ID NO: 46677 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaaacgaccagcatttccccgtcttcatgaacgagacgtcggaagagc

SEQ ID NO: 46678 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacaaccagcatttccccgtcttcatgaacgagacgtcggaagagc

SEQ ID NO: 46679 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagaaccatttccccgtcttcatgaacgagacgtcggaagagc

SEQ ID NO: 46680 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcataacttccccgtcttcatgaacgagacgtcggaagagc

SEQ ID NO: 46681 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcaaccccgtcttcatgaacgagacgtcggaagagc

SEQ ID NO: 46682 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccaacgtcttcatgaacgagacgtcggaagagc

SEQ ID NO: 46683 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaacttcatgaacgagacgtcggaagagc

SEQ ID NO: 46684 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcaacatgaacgagacgtcggaagagc

SEQ ID NO: 46685 - RNA, 299 nt, synthetic construct
  source 1..299: mol_type = other RNA
cgctcttccgcgtctcaagagggacatgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46686 - RNA, 299 nt, synthetic construct
  source 1..299: mol_type = other RNA
cgctcttccgcgtctcaagagggacatcatgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46687 - RNA, 299 nt, synthetic construct
  source 1..299: mol_type = other RNA
cgctcttccgcgtctcaagagggacatctcgatgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46688 - RNA, 299 nt, synthetic construct
  source 1..299: mol_type = other RNA
cgctcttccgcgtctcaagagggacatctcgcgaatgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46689 - RNA, 299 nt, synthetic construct
  source 1..299: mol_type = other RNA
cgctcttccgcgtctcaagagggacatctcgcgatttatgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46690 - RNA, 299 nt, synthetic construct
  source 1..299: mol_type = other RNA
cgctcttccgcgtctcaagagggacatctcgcgatttcttatggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46691 - RNA, 299 nt, synthetic construct
  source 1..299: mol_type = other RNA
cgctcttccgcgtctcaagagggacatctcgcgatttcttgagatgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46692 - RNA, 299 nt, synthetic construct
  source 1..299: mol_type = other RNA
cgctcttccgcgtctcaagagggacatctcgcgatttcttgagtctatgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46693 - RNA, 299 nt, synthetic construct
  source 1..299: mol_type = other RNA
cgctcttccgcgtctcaagagggacatctcgcgatttcttgagtctaacatgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46694 - RNA, 299 nt, synthetic construct
  source 1..299: mol_type = other RNA
cgctcttccgcgtctcaagagggacatctcgcgatttcttgagtctaaccccatggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46695 - RNA, 299 nt, synthetic construct
  source 1..299: mol_type = other RNA
cgctcttccgcgtctcaagagggacatctcgcgatttcttgagtctaaccccgtgatgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46696 - RNA, 299 nt, synthetic construct; identical to SEQ ID NO: 46695
  source 1..299: mol_type = other RNA

SEQ ID NO: 46697 - RNA, 299 nt, synthetic construct
  source 1..299: mol_type = other RNA
cgctcttccgcgtctcaagagggacatctcgcgatttcttgagtctaaccccgtgatgattatggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46698 - RNA, 299 nt, synthetic construct
  source 1..299: mol_type = other RNA
cgctcttccgcgtctcaagagggacatctcgcgatttcttgagtctaaccccgtgatgattgacatggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46699 - RNA, 299 nt, synthetic construct
  source 1..299: mol_type = other RNA
cgctcttccgcgtctcaagagggacatctcgcgatttcttgagtctaaccccgtgatgattgacgccatgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46700 - RNA, 299 nt, synthetic construct
  source 1..299: mol_type = other RNA
cgctcttccgcgtctcaagagggacatctcgcgatttcttgagtctaaccccgtgatgattgacgccaaaatggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46701 - RNA, 299 nt, synthetic construct
  source 1..299: mol_type = other RNA
cgctcttccgcgtctcaagagggacatctcgcgatttcttgagtctaaccccgtgatgattgacgccaaagaaatggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46702 - RNA, 299 nt, synthetic construct
  source 1..299: mol_type = other RNA
cgctcttccgcgtctcaagagggacatctcgcgatttcttgagtctaaccccgtgatgattgacgccaaagaagtgatgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46703 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctatggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46704 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctatggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46705 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaatgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46706 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacatgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46707 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggatggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46708 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccatgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46709 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtatgtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46710 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacatgttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46711 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcatgtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46712 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggatgggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46713 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtatgaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46714 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacatgcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46715 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttatgcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46716 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctatgggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46717 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46718 - RNA, 299 nt, synthetic construct; identical to SEQ ID NO: 46717
  source 1..299: mol_type = other RNA

SEQ ID NO: 46719 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacatgaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46720 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggatgcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46721 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctatgttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46722 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgatggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46723 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaatgtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46724 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccatgactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46725 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactatggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46726 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgatgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46727 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatatggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46728 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatatgaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46729 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagatgctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46730 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgatggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46731 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagatgctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46732 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgatgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46733 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaatggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46734 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagatgtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46735 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtatgctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46736 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgatggagcacggcagaatagccaagttcagcaaagtgaggaccattaccaccaggtcaaactctataaagcagggcaaagaccagcatttccccgtcttcatgaacgagacgtcggaagagc

SEQ ID NO: 46737 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagatgcacggcagaatagccaagttcagcaaagtgaggaccattaccaccaggtcaaactctataaagcagggcaaagaccagcatttccccgtcttcatgaacgagacgtcggaagagc

SEQ ID NO: 46738 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacatgggcagaatagccaagttcagcaaagtgaggaccattaccaccaggtcaaactctataaagcagggcaaagaccagcatttccccgtcttcatgaacgagacgtcggaagagc

SEQ ID NO: 46739 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcatgagaatagccaagttcagcaaagtgaggaccattaccaccaggtcaaactctataaagcagggcaaagaccagcatttccccgtcttcatgaacgagacgtcggaagagc

SEQ ID NO: 46740 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatgatagccaagttcagcaaagtgaggaccattaccaccaggtcaaactctataaagcagggcaaagaccagcatttccccgtcttcatgaacgagacgtcggaagagc

SEQ ID NO: 46741 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataatggccaagttcagcaaagtgaggaccattaccaccaggtcaaactctataaagcagggcaaagaccagcatttccccgtcttcatgaacgagacgtcggaagagc

SEQ ID NO: 46742 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccatgaagttcagcaaagtgaggaccattaccaccaggtcaaactctataaagcagggcaaagaccagcatttccccgtcttcatgaacgagacgtcggaagagc

SEQ ID NO: 46743 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagatgttcagcaaagtgaggaccattaccaccaggtcaaactctataaagcagggcaaagaccagcatttccccgtcttcatgaacgagacgtcggaagagc

SEQ ID NO: 46744 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcatgagcaaagtgaggaccattaccaccaggtcaaactctataaagcagggcaaagaccagcatttccccgtcttcatgaacgagacgtcggaagagc

SEQ ID NO: 46745 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcatgaaagtgaggaccattaccaccaggtcaaactctataaagcagggcaaagaccagcatttccccgtcttcatgaacgagacgtcggaagagc

SEQ ID NO: 46746 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaatggtgaggaccattaccaccaggtcaaactctataaagcagggcaaagaccagcatttccccgtcttcatgaacgagacgtcggaagagc

SEQ ID NO: 46747 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgatgaggaccattaccaccaggtcaaactctataaagcagggcaaagaccagcatttccccgtcttcatgaacgagacgtcggaagagc

SEQ ID NO: 46748 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggatgaccattaccaccaggtcaaactctataaagcagggcaaagaccagcatttccccgtcttcatgaacgagacgtcggaagagc

SEQ ID NO: 46749 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatgattaccaccaggtcaaactctataaagcagggcaaagaccagcatttccccgtcttcatgaacgagacgtcggaagagc

SEQ ID NO: 46750 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattatgaccaccaggtcaaactctataaagcagggcaaagaccagcatttccccgtcttcatgaacgagacgtcggaagagc

SEQ ID NO: 46751 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccatgaccaggtcaaactctataaagcagggcaaagaccagcatttccccgtcttcatgaacgagacgtcggaagagc

SEQ ID NO: 46752 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccatgaggtcaaactctataaagcagggcaaagaccagcatttccccgtcttcatgaacgagacgtcggaagagc

SEQ ID NO: 46753 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggatgtcaaactctataaagcagggcaaagaccagcatttccccgtcttcatgaacgagacgtcggaagagc

SEQ ID NO: 46754 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaatgaactctataaagcagggcaaagaccagcatttccccgtcttcatgaacgagacgtcggaagagc

SEQ ID NO: 46755 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacatgtctataaagcagggcaaagaccagcatttccccgtcttcatgaacgagacgtcggaagagc

SEQ ID NO: 46756 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatgataaagcagggcaaagaccagcatttccccgtcttcatgaacgagacgtcggaagagc

SEQ ID NO: 46757 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataatgaagcagggcaaagaccagcatttccccgtcttcatgaacgagacgtcggaagagc

SEQ ID NO: 46758 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagatgcagggcaaagaccagcatttccccgtcttcatgaacgagacgtcggaagagc

SEQ ID NO: 46759 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagatgggcaaagaccagcatttccccgtcttcatgaacgagacgtcggaagagc

SEQ ID NO: 46760 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcatgaaagaccagcatttccccgtcttcatgaacgagacgtcggaagagc

SEQ ID NO: 46761 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaatggaccagcatttccccgtcttcatgaacgagacgtcggaagagc

SEQ ID NO: 46762 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacatgcagcatttccccgtcttcatgaacgagacgtcggaagagc

SEQ ID NO: 46763 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagatgcatttccccgtcttcatgaacgagacgtcggaagagc

SEQ ID NO: 46764 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatatgttccccgtcttcatgaacgagacgtcggaagagc

SEQ ID NO: 46765 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcatgcccgtcttcatgaacgagacgtcggaagagc

SEQ ID NO: 46766 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccatggtcttcatgaacgagacgtcggaagagc

SEQ ID NO: 46767 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcatgttcatgaacgagacgtcggaagagc

SEQ ID NO: 46768 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgatgaacgagacgtcggaagagc

SEQ ID NO: 46769 - RNA, 299 nt, synthetic construct
  source 1..299: mol_type = other RNA
cgctcttccgcgtctcaagagggacatcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46770 - RNA, 299 nt, synthetic construct; identical to SEQ ID NO: 46769
  source 1..299: mol_type = other RNA

SEQ ID NO: 46771 - RNA, 299 nt, synthetic construct
  source 1..299: mol_type = other RNA
cgctcttccgcgtctcaagagggacatctcgatccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46772 - RNA, 299 nt, synthetic construct
  source 1..299: mol_type = other RNA
cgctcttccgcgtctcaagagggacatctcgcgaatctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46773 - RNA, 299 nt, synthetic construct
  source 1..299: mol_type = other RNA
cgctcttccgcgtctcaagagggacatctcgcgatttatccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46774 - RNA, 299 nt, synthetic construct
  source 1..299: mol_type = other RNA
cgctcttccgcgtctcaagagggacatctcgcgatttcttatcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46775 - RNA, 299 nt, synthetic construct
  source 1..299: mol_type = other RNA
cgctcttccgcgtctcaagagggacatctcgcgatttcttgagatctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46776 - RNA, 299 nt, synthetic construct
  source 1..299: mol_type = other RNA
cgctcttccgcgtctcaagagggacatctcgcgatttcttgagtctatcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46777 - RNA, 299 nt, synthetic construct
  source 1..299: mol_type = other RNA
cgctcttccgcgtctcaagagggacatctcgcgatttcttgagtctaacatccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46778 - RNA, 299 nt, synthetic construct
  source 1..299: mol_type = other RNA
cgctcttccgcgtctcaagagggacatctcgcgatttcttgagtctaaccccatcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46779 - RNA, 299 nt, synthetic construct
  source 1..299: mol_type = other RNA
cgctcttccgcgtctcaagagggacatctcgcgatttcttgagtctaaccccgtgatcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46780 - RNA, 299 nt, synthetic construct
  source 1..299: mol_type = other RNA
cgctcttccgcgtctcaagagggacatctcgcgatttcttgagtctaaccccgtgatgatcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46781 - RNA, 299 nt, synthetic construct
  source 1..299: mol_type = other RNA
cgctcttccgcgtctcaagagggacatctcgcgatttcttgagtctaaccccgtgatgattatcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46782 - RNA, 299 nt, synthetic construct
  source 1..299: mol_type = other RNA
cgctcttccgcgtctcaagagggacatctcgcgatttcttgagtctaaccccgtgatgattgacatcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46783 - RNA, 299 nt, synthetic construct
  source 1..299: mol_type = other RNA
cgctcttccgcgtctcaagagggacatctcgcgatttcttgagtctaaccccgtgatgattgacgccatcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46784 - RNA, 299 nt, synthetic construct
  source 1..299: mol_type = other RNA
cgctcttccgcgtctcaagagggacatctcgcgatttcttgagtctaaccccgtgatgattgacgccaaaatcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46785 - RNA, 299 nt, synthetic construct
  source 1..299: mol_type = other RNA
cgctcttccgcgtctcaagagggacatctcgcgatttcttgagtctaaccccgtgatgattgacgccaaagaaatcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46786 - RNA, 299 nt, synthetic construct
  source 1..299: mol_type = other RNA
cgctcttccgcgtctcaagagggacatctcgcgatttcttgagtctaaccccgtgatgattgacgccaaagaagtgatctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46787 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctatcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46788 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctatcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46789 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaatccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46790 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacatcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46791 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggatcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46792 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccatccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46793 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtatctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46794 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacatcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46795 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcatctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46796 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggatcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46797 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtatcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46798 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacatccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46799 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttatccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46800 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctatcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46801 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46802 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgatcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46803 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacatcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46804 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggatccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46805 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctatcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46806 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgatcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46807 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaatctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46808 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccatcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46809 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactatcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46810 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgatcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46811 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatatcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46812 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatatcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46813 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagatcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46814 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgatcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46815 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagatcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46816 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgatccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46817 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaatcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46818 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagatctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46819 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtatcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46820 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgatcgagcacggcagaatagccaagttcagcaaagtgaggaccattaccaccaggtcaaactctataaagcagggcaaagaccagcatttccccgtcttcatgaacgagacgtcggaagagc

SEQ ID NO: 46821 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagatccacggcagaatagccaagttcagcaaagtgaggaccattaccaccaggtcaaactctataaagcagggcaaagaccagcatttccccgtcttcatgaacgagacgtcggaagagc

SEQ ID NO: 46822 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacatcggcagaatagccaagttcagcaaagtgaggaccattaccaccaggtcaaactctataaagcagggcaaagaccagcatttccccgtcttcatgaacgagacgtcggaagagc

SEQ ID NO: 46823 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcatcagaatagccaagttcagcaaagtgaggaccattaccaccaggtcaaactctataaagcagggcaaagaccagcatttccccgtcttcatgaacgagacgtcggaagagc

SEQ ID NO: 46824 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatcatagccaagttcagcaaagtgaggaccattaccaccaggtcaaactctataaagcagggcaaagaccagcatttccccgtcttcatgaacgagacgtcggaagagc

SEQ ID NO: 46825 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataatcgccaagttcagcaaagtgaggaccattaccaccaggtcaaactctataaagcagggcaaagaccagcatttccccgtcttcatgaacgagacgtcggaagagc

SEQ ID NO: 46826 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccatcaagttcagcaaagtgaggaccattaccaccaggtcaaactctataaagcagggcaaagaccagcatttccccgtcttcatgaacgagacgtcggaagagc

SEQ ID NO: 46827 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagatcttcagcaaagtgaggaccattaccaccaggtcaaactctataaagcagggcaaagaccagcatttccccgtcttcatgaacgagacgtcggaagagc

SEQ ID NO: 46828 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcatcagcaaagtgaggaccattaccaccaggtcaaactctataaagcagggcaaagaccagcatttccccgtcttcatgaacgagacgtcggaagagc

SEQ ID NO: 46829 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcatcaaagtgaggaccattaccaccaggtcaaactctataaagcagggcaaagaccagcatttccccgtcttcatgaacgagacgtcggaagagc

SEQ ID NO: 46830 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaatcgtgaggaccattaccaccaggtcaaactctataaagcagggcaaagaccagcatttccccgtcttcatgaacgagacgtcggaagagc

SEQ ID NO: 46831 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgatcaggaccattaccaccaggtcaaactctataaagcagggcaaagaccagcatttccccgtcttcatgaacgagacgtcggaagagc

SEQ ID NO: 46832 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggatcaccattaccaccaggtcaaactctataaagcagggcaaagaccagcatttccccgtcttcatgaacgagacgtcggaagagc

SEQ ID NO: 46833 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccatcattaccaccaggtcaaactctataaagcagggcaaagaccagcatttccccgtcttcatgaacgagacgtcggaagagc

SEQ ID NO: 46834 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattatcaccaccaggtcaaactctataaagcagggcaaagaccagcatttccccgtcttcatgaacgagacgtcggaagagc

SEQ ID NO: 46835 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccatcaccaggtcaaactctataaagcagggcaaagaccagcatttccccgtcttcatgaacgagacgtcggaagagc

SEQ ID NO: 46836 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccatcaggtcaaactctataaagcagggcaaagaccagcatttccccgtcttcatgaacgagacgtcggaagagc

SEQ ID NO: 46837 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggatctcaaactctataaagcagggcaaagaccagcatttccccgtcttcatgaacgagacgtcggaagagc

SEQ ID NO: 46838 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaatcaactctataaagcagggcaaagaccagcatttccccgtcttcatgaacgagacgtcggaagagc

SEQ ID NO: 46839 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacatctctataaagcagggcaaagaccagcatttccccgtcttcatgaacgagacgtcggaagagc

SEQ ID NO: 46840 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctatcataaagcagggcaaagaccagcatttccccgtcttcatgaacgagacgtcggaagagc

SEQ ID NO: 46841 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataatcaagcagggcaaagaccagcatttccccgtcttcatgaacgagacgtcggaagagc

SEQ ID NO: 46842 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagatccagggcaaagaccagcatttccccgtcttcatgaacgagacgtcggaagagc

SEQ ID NO: 46843 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagatcggcaaagaccagcatttccccgtcttcatgaacgagacgtcggaagagc

SEQ ID NO: 46844 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcatcaaagaccagcatttccccgtcttcatgaacgagacgtcggaagagc

SEQ ID NO: 46845 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaatcgaccagcatttccccgtcttcatgaacgagacgtcggaagagc

SEQ ID NO: 46846 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacatccagcatttccccgtcttcatgaacgagacgtcggaagagc

SEQ ID NO: 46847 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagatccatttccccgtcttcatgaacgagacgtcggaagagc

SEQ ID NO: 46848 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatatcttccccgtcttcatgaacgagacgtcggaagagc

SEQ ID NO: 46849 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcatccccgtcttcatgaacgagacgtcggaagagc

SEQ ID NO: 46850 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccatcgtcttcatgaacgagacgtcggaagagc

SEQ ID NO: 46851 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcatcttcatgaacgagacgtcggaagagc

SEQ ID NO: 46852 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatcatgaacgagacgtcggaagagc

SEQ ID NO: 46853 - RNA, 299 nt, synthetic construct
  source 1..299: mol_type = other RNA
cgctcttccgcgtctcaagagggacaggatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46854 - RNA, 299 nt, synthetic construct
  source 1..299: mol_type = other RNA
cgctcttccgcgtctcaagagggacatcaggtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46855 - RNA, 299 nt, synthetic construct
  source 1..299: mol_type = other RNA
cgctcttccgcgtctcaagagggacatctcgaggcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46856 - RNA, 299 nt, synthetic construct
  source 1..299: mol_type = other RNA
cgctcttccgcgtctcaagagggacatctcgcgaaggtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46857 - RNA, 299 nt, synthetic construct
  source 1..299: mol_type = other RNA
cgctcttccgcgtctcaagagggacatctcgcgatttaggcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46858 - RNA, 299 nt, synthetic construct
  source 1..299: mol_type = other RNA
cgctcttccgcgtctcaagagggacatctcgcgatttcttagggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46859 - RNA, 299 nt, synthetic construct
  source 1..299: mol_type = other RNA
cgctcttccgcgtctcaagagggacatctcgcgatttcttgagaggtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46860 - RNA, 299 nt, synthetic construct
  source 1..299: mol_type = other RNA
cgctcttccgcgtctcaagagggacatctcgcgatttcttgagtctaggaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46861 - RNA, 299 nt, synthetic construct
  source 1..299: mol_type = other RNA
cgctcttccgcgtctcaagagggacatctcgcgatttcttgagtctaacaggcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46862 - RNA, 299 nt, synthetic construct
  source 1..299: mol_type = other RNA
cgctcttccgcgtctcaagagggacatctcgcgatttcttgagtctaaccccagggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46863 - RNA, 299 nt, synthetic construct
  source 1..299: mol_type = other RNA
cgctcttccgcgtctcaagagggacatctcgcgatttcttgagtctaaccccgtgaggatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46864 - RNA, 299 nt, synthetic construct
  source 1..299: mol_type = other RNA
cgctcttccgcgtctcaagagggacatctcgcgatttcttgagtctaaccccgtgatgaggattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46865 - RNA, 299 nt, synthetic construct
  source 1..299: mol_type = other RNA
cgctcttccgcgtctcaagagggacatctcgcgatttcttgagtctaaccccgtgatgattagggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46866 - RNA, 299 nt, synthetic construct
  source 1..299: mol_type = other RNA
cgctcttccgcgtctcaagagggacatctcgcgatttcttgagtctaaccccgtgatgattgacagggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46867 - RNA, 299 nt, synthetic construct
  source 1..299: mol_type = other RNA
cgctcttccgcgtctcaagagggacatctcgcgatttcttgagtctaaccccgtgatgattgacgccaggaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46868 - RNA, 299 nt, synthetic construct
  source 1..299: mol_type = other RNA
cgctcttccgcgtctcaagagggacatctcgcgatttcttgagtctaaccccgtgatgattgacgccaaaagggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46869 - RNA, 299 nt, synthetic construct
  source 1..299: mol_type = other RNA
cgctcttccgcgtctcaagagggacatctcgcgatttcttgagtctaaccccgtgatgattgacgccaaagaaagggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46870 - RNA, 299 nt, synthetic construct
  source 1..299: mol_type = other RNA
cgctcttccgcgtctcaagagggacatctcgcgatttcttgagtctaaccccgtgatgattgacgccaaagaagtgaggtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46871 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctagggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46872 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctagggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46873 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaaggcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46874 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46875 - RNA, 299 nt, synthetic construct; identical to SEQ ID NO: 46874
  source 1..299: mol_type = other RNA

SEQ ID NO: 46876 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccaggcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46877 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtaggtacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46878 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacaggttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46879 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcaggtggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46880 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggaggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46881 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaggaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46882 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacaggcttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46883 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttaggcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46884 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctaggggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46885 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcaggatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46886 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaggaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46887 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46888 - RNA, 299 nt, synthetic construct; identical to SEQ ID NO: 46887
  source 1..299: mol_type = other RNA

SEQ ID NO: 46889 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctaggttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46890 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgagggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46891 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaaggtccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46892 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccaggactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46893 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactagggtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46894 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaggaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46895 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatagggataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46896 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataggaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46897 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagaggctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46898 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgagggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46899 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagaggctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46900 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgaggcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46901 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaagggagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46902 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagaggtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46903 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtaggctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46904 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgagggagcacggcagaatagccaagttcagcaaagtgaggaccattaccaccaggtcaaactctataaagcagggcaaagaccagcatttccccgtcttcatgaacgagacgtcggaagagc

SEQ ID NO: 46905 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagaggcacggcagaatagccaagttcagcaaagtgaggaccattaccaccaggtcaaactctataaagcagggcaaagaccagcatttccccgtcttcatgaacgagacgtcggaagagc

SEQ ID NO: 46906 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacaggggcagaatagccaagttcagcaaagtgaggaccattaccaccaggtcaaactctataaagcagggcaaagaccagcatttccccgtcttcatgaacgagacgtcggaagagc

SEQ ID NO: 46907 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcaggagaatagccaagttcagcaaagtgaggaccattaccaccaggtcaaactctataaagcagggcaaagaccagcatttccccgtcttcatgaacgagacgtcggaagagc

SEQ ID NO: 46908 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaaggatagccaagttcagcaaagtgaggaccattaccaccaggtcaaactctataaagcagggcaaagaccagcatttccccgtcttcatgaacgagacgtcggaagagc

SEQ ID NO: 46909 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataagggccaagttcagcaaagtgaggaccattaccaccaggtcaaactctataaagcagggcaaagaccagcatttccccgtcttcatgaacgagacgtcggaagagc

SEQ ID NO: 46910 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaggaagttcagcaaagtgaggaccattaccaccaggtcaaactctataaagcagggcaaagaccagcatttccccgtcttcatgaacgagacgtcggaagagc

SEQ ID NO: 46911 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagaggttcagcaaagtgaggaccattaccaccaggtcaaactctataaagcagggcaaagaccagcatttccccgtcttcatgaacgagacgtcggaagagc

SEQ ID NO: 46912 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcaggagcaaagtgaggaccattaccaccaggtcaaactctataaagcagggcaaagaccagcatttccccgtcttcatgaacgagacgtcggaagagc

SEQ ID NO: 46913 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaggaaagtgaggaccattaccaccaggtcaaactctataaagcagggcaaagaccagcatttccccgtcttcatgaacgagacgtcggaagagc

SEQ ID NO: 46914 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaagggtgaggaccattaccaccaggtcaaactctataaagcagggcaaagaccagcatttccccgtcttcatgaacgagacgtcggaagagc

SEQ ID NO: 46915 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaggaccattaccaccaggtcaaactctataaagcagggcaaagaccagcatttccccgtcttcatgaacgagacgtcggaagagc

SEQ ID NO: 46916 - RNA, 299 nt, synthetic construct; identical to SEQ ID NO: 46915
  source 1..299: mol_type = other RNA

SEQ ID NO: 46917 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccaggattaccaccaggtcaaactctataaagcagggcaaagaccagcatttccccgtcttcatgaacgagacgtcggaagagc

SEQ ID NO: 46918 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaggaccaccaggtcaaactctataaagcagggcaaagaccagcatttccccgtcttcatgaacgagacgtcggaagagc

SEQ ID NO: 46919 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaggaccaggtcaaactctataaagcagggcaaagaccagcatttccccgtcttcatgaacgagacgtcggaagagc

SEQ ID NO: 46920 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggaggtcaaactctataaagcagggcaaagaccagcatttccccgtcttcatgaacgagacgtcggaagagc

SEQ ID NO: 46921 - RNA, 299 nt, synthetic construct; identical to SEQ ID NO: 46920
  source 1..299: mol_type = other RNA

SEQ ID NO: 46922 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaggaactctataaagcagggcaaagaccagcatttccccgtcttcatgaacgagacgtcggaagagc

SEQ ID NO: 46923 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacaggtctataaagcagggcaaagaccagcatttccccgtcttcatgaacgagacgtcggaagagc

SEQ ID NO: 46924 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctaggataaagcagggcaaagaccagcatttccccgtcttcatgaacgagacgtcggaagagc

SEQ ID NO: 46925 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaggaagcagggcaaagaccagcatttccccgtcttcatgaacgagacgtcggaagagc

SEQ ID NO: 46926 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagaggcagggcaaagaccagcatttccccgtcttcatgaacgagacgtcggaagagc

SEQ ID NO: 46927 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagaggggcaaagaccagcatttccccgtcttcatgaacgagacgtcggaagagc

SEQ ID NO: 46928 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaggaaagaccagcatttccccgtcttcatgaacgagacgtcggaagagc

SEQ ID NO: 46929 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaagggaccagcatttccccgtcttcatgaacgagacgtcggaagagc

SEQ ID NO: 46930 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacaggcagcatttccccgtcttcatgaacgagacgtcggaagagc

SEQ ID NO: 46931 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagaggcatttccccgtcttcatgaacgagacgtcggaagagc

SEQ ID NO: 46932 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcataggttccccgtcttcatgaacgagacgtcggaagagc

SEQ ID NO: 46933 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcaggcccgtcttcatgaacgagacgtcggaagagc

SEQ ID NO: 46934 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccagggtcttcatgaacgagacgtcggaagagc

SEQ ID NO: 46935 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcaggttcatgaacgagacgtcggaagagc

SEQ ID NO: 46936 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcaggatgaacgagacgtcggaagagc

SEQ ID NO: 46937 - RNA, 299 nt, synthetic construct
  source 1..299: mol_type = other RNA
cgctcttccgcgtctcaagagggacagcatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46938 - RNA, 299 nt, synthetic construct
  source 1..299: mol_type = other RNA
cgctcttccgcgtctcaagagggacatcagctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46939 - RNA, 299 nt, synthetic construct
  source 1..299: mol_type = other RNA
cgctcttccgcgtctcaagagggacatctcgagccgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46940 - RNA, 299 nt, synthetic construct
  source 1..299: mol_type = other RNA
cgctcttccgcgtctcaagagggacatctcgcgaagctttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46941 - RNA, 299 nt, synthetic construct
  source 1..299: mol_type = other RNA
cgctcttccgcgtctcaagagggacatctcgcgatttagccttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46942 - RNA, 299 nt, synthetic construct
  source 1..299: mol_type = other RNA
cgctcttccgcgtctcaagagggacatctcgcgatttcttagcgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46943 - RNA, 299 nt, synthetic construct
  source 1..299: mol_type = other RNA
cgctcttccgcgtctcaagagggacatctcgcgatttcttgagagctctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46944 - RNA, 299 nt, synthetic construct
  source 1..299: mol_type = other RNA
cgctcttccgcgtctcaagagggacatctcgcgatttcttgagtctagcaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46945 - RNA, 299 nt, synthetic construct
  source 1..299: mol_type = other RNA
cgctcttccgcgtctcaagagggacatctcgcgatttcttgagtctaacagccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46946 - RNA, 299 nt, synthetic construct
  source 1..299: mol_type = other RNA
cgctcttccgcgtctcaagagggacatctcgcgatttcttgagtctaaccccagcgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46947 - RNA, 299 nt, synthetic construct
  source 1..299: mol_type = other RNA
cgctcttccgcgtctcaagagggacatctcgcgatttcttgagtctaaccccgtgagcatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46948 - RNA, 299 nt, synthetic construct
  source 1..299: mol_type = other RNA
cgctcttccgcgtctcaagagggacatctcgcgatttcttgagtctaaccccgtgatgagcattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46949 - RNA, 299 nt, synthetic construct
  source 1..299: mol_type = other RNA
cgctcttccgcgtctcaagagggacatctcgcgatttcttgagtctaaccccgtgatgattagcgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46950 - RNA, 299 nt, synthetic construct
  source 1..299: mol_type = other RNA
cgctcttccgcgtctcaagagggacatctcgcgatttcttgagtctaaccccgtgatgattgacagcgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46951 - RNA, 299 nt, synthetic construct
  source 1..299: mol_type = other RNA
cgctcttccgcgtctcaagagggacatctcgcgatttcttgagtctaaccccgtgatgattgacgccagcaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46952 - RNA, 299 nt, synthetic construct
  source 1..299: mol_type = other RNA
cgctcttccgcgtctcaagagggacatctcgcgatttcttgagtctaaccccgtgatgattgacgccaaaagcgaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46953 - RNA, 299 nt, synthetic construct
  source 1..299: mol_type = other RNA
cgctcttccgcgtctcaagagggacatctcgcgatttcttgagtctaaccccgtgatgattgacgccaaagaaagcgtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46954 - RNA, 299 nt, synthetic construct
  source 1..299: mol_type = other RNA
cgctcttccgcgtctcaagagggacatctcgcgatttcttgagtctaaccccgtgatgattgacgccaaagaagtgagctctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46955 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctagcgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46956 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctagcgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46957 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaagccacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46958 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagcagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46959 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggagcgcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46960 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccagccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46961 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgtagctacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46962 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacagcttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46963 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttcagctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46964 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggagcggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46965 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtagcaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46966 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaacagccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46967 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttagccctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46968 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctagcggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46969 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcagcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46970 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgagcaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46971 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacagcaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46972 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggagccctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46973 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctagcttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46974 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttgagcgcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46975 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcaagctccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46976 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccagcactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46977 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactagcgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46978 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgagcaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46979 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatagcgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46980 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgatagcaagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46981 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagagcctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46982 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctgagcgagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46983 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagagcctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46984 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgagccaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46985 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaaagcgagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46986 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagagctgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46987 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtagcctggagcacggcagaatagccaagttcagcaaagtgaggaccattaccaccaggtcaaactctataaagcagggcaaagaccagcatttccccgtcttcatgaacgagacgtcggaagagc

SEQ ID NO: 46988 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctgagcgagcacggcagaatagccaagttcagcaaagtgaggaccattaccaccaggtcaaactctataaagcagggcaaagaccagcatttccccgtcttcatgaacgagacgtcggaagagc

SEQ ID NO: 46989 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagagccacggcagaatagccaagttcagcaaagtgaggaccattaccaccaggtcaaactctataaagcagggcaaagaccagcatttccccgtcttcatgaacgagacgtcggaagagc

SEQ ID NO: 46990 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacagcggcagaatagccaagttcagcaaagtgaggaccattaccaccaggtcaaactctataaagcagggcaaagaccagcatttccccgtcttcatgaacgagacgtcggaagagc

SEQ ID NO: 46991 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagcagaatagccaagttcagcaaagtgaggaccattaccaccaggtcaaactctataaagcagggcaaagaccagcatttccccgtcttcatgaacgagacgtcggaagagc

SEQ ID NO: 46992 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaagcatagccaagttcagcaaagtgaggaccattaccaccaggtcaaactctataaagcagggcaaagaccagcatttccccgtcttcatgaacgagacgtcggaagagc

SEQ ID NO: 46993 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaataagcgccaagttcagcaaagtgaggaccattaccaccaggtcaaactctataaagcagggcaaagaccagcatttccccgtcttcatgaacgagacgtcggaagagc

SEQ ID NO: 46994 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccagcaagttcagcaaagtgaggaccattaccaccaggtcaaactctataaagcagggcaaagaccagcatttccccgtcttcatgaacgagacgtcggaagagc

SEQ ID NO: 46995 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagagcttcagcaaagtgaggaccattaccaccaggtcaaactctataaagcagggcaaagaccagcatttccccgtcttcatgaacgagacgtcggaagagc

SEQ ID NO: 46996 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcagcaaagtgaggaccattaccaccaggtcaaactctataaagcagggcaaagaccagcatttccccgtcttcatgaacgagacgtcggaagagc

SEQ ID NO: 46997 - RNA, 299 nt, synthetic construct; identical to SEQ ID NO: 46996
  source 1..299: mol_type = other RNA

SEQ ID NO: 46998 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaaagcgtgaggaccattaccaccaggtcaaactctataaagcagggcaaagaccagcatttccccgtcttcatgaacgagacgtcggaagagc

SEQ ID NO: 46999 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgagcaggaccattaccaccaggtcaaactctataaagcagggcaaagaccagcatttccccgtcttcatgaacgagacgtcggaagagc

SEQ ID NO: 47000 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggagcaccattaccaccaggtcaaactctataaagcagggcaaagaccagcatttccccgtcttcatgaacgagacgtcggaagagc

SEQ ID NO: 47001 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccagcattaccaccaggtcaaactctataaagcagggcaaagaccagcatttccccgtcttcatgaacgagacgtcggaagagc

SEQ ID NO: 47002 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattagcaccaccaggtcaaactctataaagcagggcaaagaccagcatttccccgtcttcatgaacgagacgtcggaagagc

SEQ ID NO: 47003 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccagcaccaggtcaaactctataaagcagggcaaagaccagcatttccccgtcttcatgaacgagacgtcggaagagc

SEQ ID NO: 47004 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccagcaggtcaaactctataaagcagggcaaagaccagcatttccccgtcttcatgaacgagacgtcggaagagc

SEQ ID NO: 47005 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggagctcaaactctataaagcagggcaaagaccagcatttccccgtcttcatgaacgagacgtcggaagagc

SEQ ID NO: 47006 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaagcaactctataaagcagggcaaagaccagcatttccccgtcttcatgaacgagacgtcggaagagc

SEQ ID NO: 47007 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaacagctctataaagcagggcaaagaccagcatttccccgtcttcatgaacgagacgtcggaagagc

SEQ ID NO: 47008 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctagcataaagcagggcaaagaccagcatttccccgtcttcatgaacgagacgtcggaagagc

SEQ ID NO: 47009 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataagcaagcagggcaaagaccagcatttccccgtcttcatgaacgagacgtcggaagagc

SEQ ID NO: 47010 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagagccagggcaaagaccagcatttccccgtcttcatgaacgagacgtcggaagagc

SEQ ID NO: 47011 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagagcggcaaagaccagcatttccccgtcttcatgaacgagacgtcggaagagc

SEQ ID NO: 47012 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcagcaaagaccagcatttccccgtcttcatgaacgagacgtcggaagagc

SEQ ID NO: 47013 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaaagcgaccagcatttccccgtcttcatgaacgagacgtcggaagagc

SEQ ID NO: 47014 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagacagccagcatttccccgtcttcatgaacgagacgtcggaagagc

SEQ ID NO: 47015 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagagccatttccccgtcttcatgaacgagacgtcggaagagc

SEQ ID NO: 47016 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatagcttccccgtcttcatgaacgagacgtcggaagagc

SEQ ID NO: 47017 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttcagccccgtcttcatgaacgagacgtcggaagagc

SEQ ID NO: 47018 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccagcgtcttcatgaacgagacgtcggaagagc

SEQ ID NO: 47019 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcagcttcatgaacgagacgtcggaagagc

SEQ ID NO: 47020 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcagcatgaacgagacgtcggaagagc

SEQ ID NO: 47021 - RNA, 299 nt, synthetic construct
  source 1..299: mol_type = other RNA
cgctcttccgcgtctcaagagggacacgatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47022 - RNA, 299 nt, synthetic construct
  source 1..299: mol_type = other RNA
cgctcttccgcgtctcaagagggacatcacgtcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47023 - RNA, 299 nt, synthetic construct
  source 1..299: mol_type = other RNA
cgctcttccgcgtctcaagagggacatctcgacgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47024 - RNA, 299 nt, synthetic construct
  source 1..299: mol_type = other RNA
cgctcttccgcgtctcaagagggacatctcgcgaacgtttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47025 - RNA, 299 nt, synthetic construct
  source 1..299: mol_type = other RNA
cgctcttccgcgtctcaagagggacatctcgcgatttacgcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47026 - RNA, 299 nt, synthetic construct
  source 1..299: mol_type = other RNA
cgctcttccgcgtctcaagagggacatctcgcgatttcttacggagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47027 - RNA, 299 nt, synthetic construct
  source 1..299: mol_type = other RNA
cgctcttccgcgtctcaagagggacatctcgcgatttcttgagacgtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47028 - RNA, 299 nt, synthetic construct
  source 1..299: mol_type = other RNA
cgctcttccgcgtctcaagagggacatctcgcgatttcttgagtctacgaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47029 - RNA, 299 nt, synthetic construct
  source 1..299: mol_type = other RNA
cgctcttccgcgtctcaagagggacatctcgcgatttcttgagtctaacacgcccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47030 - RNA, 299 nt, synthetic construct
  source 1..299: mol_type = other RNA
cgctcttccgcgtctcaagagggacatctcgcgatttcttgagtctaaccccacggtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47031 - RNA, 299 nt, synthetic construct
  source 1..299: mol_type = other RNA
cgctcttccgcgtctcaagagggacatctcgcgatttcttgagtctaaccccgtgacgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47032 - RNA, 299 nt, synthetic construct
  source 1..299: mol_type = other RNA
cgctcttccgcgtctcaagagggacatctcgcgatttcttgagtctaaccccgtgatgacgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47033 - RNA, 299 nt, synthetic construct
  source 1..299: mol_type = other RNA
cgctcttccgcgtctcaagagggacatctcgcgatttcttgagtctaaccccgtgatgattacggacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47034 - RNA, 299 nt, synthetic construct
  source 1..299: mol_type = other RNA
cgctcttccgcgtctcaagagggacatctcgcgatttcttgagtctaaccccgtgatgattgacacggccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47035 - RNA, 299 nt, synthetic construct
  source 1..299: mol_type = other RNA
cgctcttccgcgtctcaagagggacatctcgcgatttcttgagtctaaccccgtgatgattgacgccacgaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47036 - RNA, 299 nt, synthetic construct
  source 1..299: mol_type = other RNA
cgctcttccgcgtctcaagagggacatctcgcgatttcttgagtctaaccccgtgatgattgacgccaaaacggaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47037 - RNA, 299 nt, synthetic construct
  source 1..299: mol_type = other RNA
cgctcttccgcgtctcaagagggacatctcgcgatttcttgagtctaaccccgtgatgattgacgccaaagaaacggtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47038 - RNA, 299 nt, synthetic construct
  source 1..299: mol_type = other RNA
cgctcttccgcgtctcaagagggacatctcgcgatttcttgagtctaaccccgtgatgattgacgccaaagaagtgacgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47039 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctacggctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47040 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctacggcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47041 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcaacgcacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47042 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacacgagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47043 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacaggacggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc

SEQ ID NO: 47044 - RNA, 299 nt, synthetic construct
  source 1..299: mol_type = other RNA
cgctcttccgcgtctcaagagggacatctcgcgatttcttgagtctaaccccgtgatgattgacgccaaagaagtgtctgctgcacacagggccacgcgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagacgtcggaagagc
